US008993838B2

(12) United States Patent
Sarria-Millan et al.

(10) Patent No.: US 8,993,838 B2
(45) Date of Patent: Mar. 31, 2015

(54) YIELD INCREASE IN PLANTS OVEREXPRESSING THE SHSRP GENES

(71) Applicant: BASF Plant Science GmbH, Ludwigshafen (DE)

(72) Inventors: Rodrigo Sarria-Millan, West Lafayette, IN (US); Eric Garr, Holly Springs, NC (US); Jamie Susan Haertel, Berlin (DE); Damian Allen, West Lafayette, IN (US); Bryan D. McKersie, Raleigh, NC (US)

(73) Assignee: BASF Plant Science GmbH (DE)

( * ) Notice: Subject to any disclaimer, the term of this patent is extended or adjusted under 35 U.S.C. 154(b) by 246 days.

(21) Appl. No.: 13/629,800

(22) Filed: Sep. 28, 2012

(65) Prior Publication Data

US 2014/0230094 A1 Aug. 14, 2014

Related U.S. Application Data

(63) Continuation of application No. 11/988,851, filed as application No. PCT/US2006/027384 on Jul. 13, 2006, now abandoned.

(60) Provisional application No. 60/700,267, filed on Jul. 18, 2005.

(51) Int. Cl.
| | | |
|---|---|---|
| *A01H 1/00* | (2006.01) |
| *C12N 15/00* | (2006.01) |
| *C12N 15/63* | (2006.01) |
| *C12N 15/82* | (2006.01) |
| *C12N 9/10* | (2006.01) |
| *A01H 5/00* | (2006.01) |
| *C07H 21/04* | (2006.01) |
| *C07K 14/415* | (2006.01) |

(52) U.S. Cl.
CPC .......... *C12N 15/8227* (2013.01); *C07K 14/415* (2013.01); *C12N 9/1014* (2013.01); *C12N 15/8261* (2013.01); *C12N 15/8271* (2013.01); *C12N 15/8273* (2013.01)
USPC ........ 800/278; 435/468; 435/320.1; 435/183; 435/419; 530/370; 536/23.2; 536/23.6; 800/295

(58) Field of Classification Search
None
See application file for complete search history.

(56) References Cited

FOREIGN PATENT DOCUMENTS

EP 1033405 A2 * 9/2000

* cited by examiner

*Primary Examiner* — Phuong Bui
(74) *Attorney, Agent, or Firm* — Patricia A. McDaniels

(57) ABSTRACT

A transgenic crop plant transformed by a Serine Hydroxymethyltransferase-Like Stress-Related Polypeptide (SHSRP) coding nucleic acid, wherein expression of the nucleic acid sequence in the crop plant results in the plant's increased root growth, and/or increased yield, and/or increased tolerance to environmental stress as compared to a wild type variety of the plant. Also provided are agricultural products, including seeds, produced by the transgenic crop plants. Also provided are isolated novel SHSRPs, and isolated novel nucleic acids encoding SHSRPs, and vectors and transgenic plant containing the same.

12 Claims, 14 Drawing Sheets

Figure 1 cDNA sequence of SHMT4 from *Arabidopsis thaliana*

ATGGAACCAGTCTCTTCATGGGGTAACACCTCTCTCGTCTCCGTAGATCCAGAGATCCACGACCTAATCG
AGAAGGAGAAACGTCGGCAATGTCGAGGAATCGAACTTATCGCTTCCGAGAATTTCACTTCCTTCGCCGT
CATCGAAGCTCTCGGAAGTGCCTTAACCAACAAATACTCCGAAGGTATTCCTGGTAATCGTTATTACGGA
GGTAACGAATTCATCGATGAGATCGAGAATCTTTGCCGTTCAAGAGCTCTCGAAGCTTTCCATTGTGATC
CAGCAGCGTGGGGCGTTAATGTTCAGCCGTATTCTGGATCTCCGGCAAATTTCGCTGCTTACACGGCTTT
GCTTCAGCCTCACGATCGTATCATGGGGCTTGATTTGCCTTCAGGTGGTCATTTGACTCATGGTTACTAT
ACATCTGGTGGTAAGAAGATCTCTGCGACTTCGATCTACTTTGAGAGTCTTCCGTATAAGGTGAATTTCA
CCACTGGTTACATTGATTACGATAAGCTTGAAGAGAAGGCGTTGGATTTCAGGCCTAAGTTGCTTATCTG
TGGTGGTAGTGCGTATCCTAGGGATTGGGATTACGCTAGATTTAGAGCTATTGCTGATAAGGTTGGAGCT
C`TTTTGCTTTGTGACATGGCTCACATCAGTGGTCTCGTTGCTGCTCAGGAAGCTGCAAACCCATTTGAG
TACTGTGACGTTGTGACAACCACAACCCACAAGAGTTTGAGGGGTCCAAGGGCTGGTATGATTTTCTACA
GGAAGGGTCCAAAACCACCAAAGAAGGGTCAACCCGAGGGTGCAGTCTATGATTTTGAGGACAAAATCAA
CTTTGCTGTATTCCCTGCGCTTCAAGGTGGTCCTCACAATCACCAGATTGGTGCTCTAGCTGTTGCGTTG
AAGCAGGCTAATACTCCTGGGTTCAAGGTCTACGCAAAACAAGTGAAAGCCAATGCTGTTGCCCTTGGAA
ACTACCTAATGAGCAAGGGTTACCAGATTGTGACCAATGGAACTGAGAACCACCTTGTTCTCTGGGATCT
TCGCCCTCTTGGATTGACCGGAAACAAGGTTGAGAAGCTCTGCGATCTGTGCAGCATTACATTGAACAAG
AACGCAGTATTTGGAGACAGTAGTGCTCTTGCTCCTGGAGGTGTAAGAATCGGTGCACCCGCGATGACAT
CGAGAGGATTGGTGGAGAAGGACTTTGAGCAGATAGGAGAATTCCTGAGCCGTGCAGTGACACTGACGTT
GGACATCCAAAAGACATACGGTAAGTTGTTGAAGGACTTCAACAAGGGTTTGGTGAACAACAAAGATCTC
GATCAGCTCAAGGCTGATGTCGAGAAGTTCTCGGCGTCTTATGAGATGCCTGGATTCCTCATGTCTGAGA
TGAAGTACAAGGATTAG

Figure 2

Deduced amino acid sequence of SHMT4 from *Arabidopsis thaliana*

MEPVSSWGNTSLVSVDPEIHDLIEKEKRRQCRGIELIASENFTSFAVIEALGSALTNKYSEGIPGNRYYG
GNEFIDEIENLCRSRALEAFHCDPAAWGVNVQPYSGSPANFAAYTALLQPHDRIMGLDLPSGGHLTHGYY
TSGGKKISATSIYFESLPYKVNFTTGYIDYDKLEEKALDFRPKLLICGGSAYPRDWDYARFRAIADKVGA
LLLCDMAHISGLVAAQEAANPFEYCDVVTTTTHKSLRGPRAGMIFYRKGPKPPKKGQPEGAVYDFEDKIN
FAVFPALQGGPHNHQIGALAVALKQANTPGFKVYAKQVKANAVALGNYLMSKGYQIVTNGTENHLVLWDL
RPLGLTGNKVEKLCDLCSITLNKNAVFGDSSALAPGGVRIGAPAMTSRGLVEKDFEQIGEFLSRAVTLTL
DIQKTYGKLLKDFNKGLVNNKDLDQLKADVEKFSASYEMPGFLMSEMKYKD

Figure 3

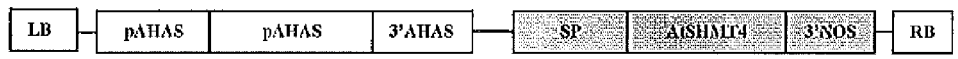

Figures 4A and 4B
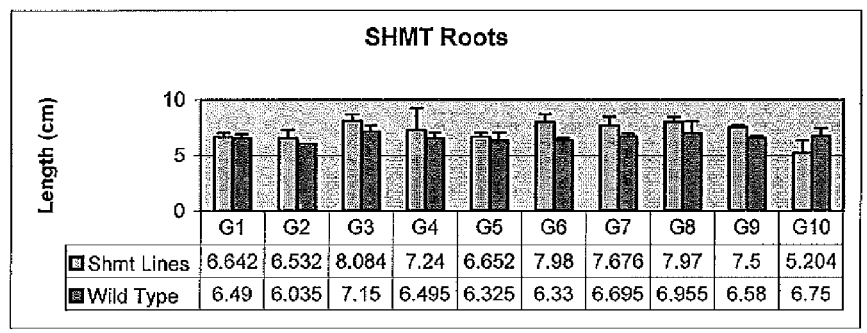
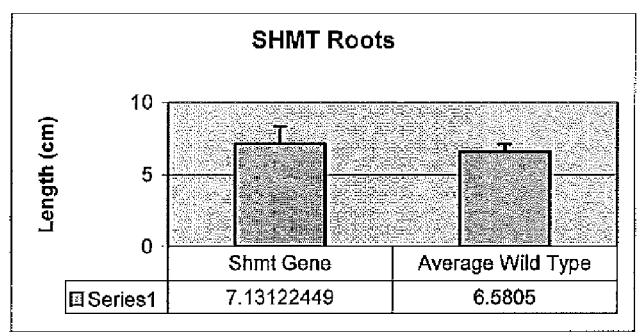
Figure 5
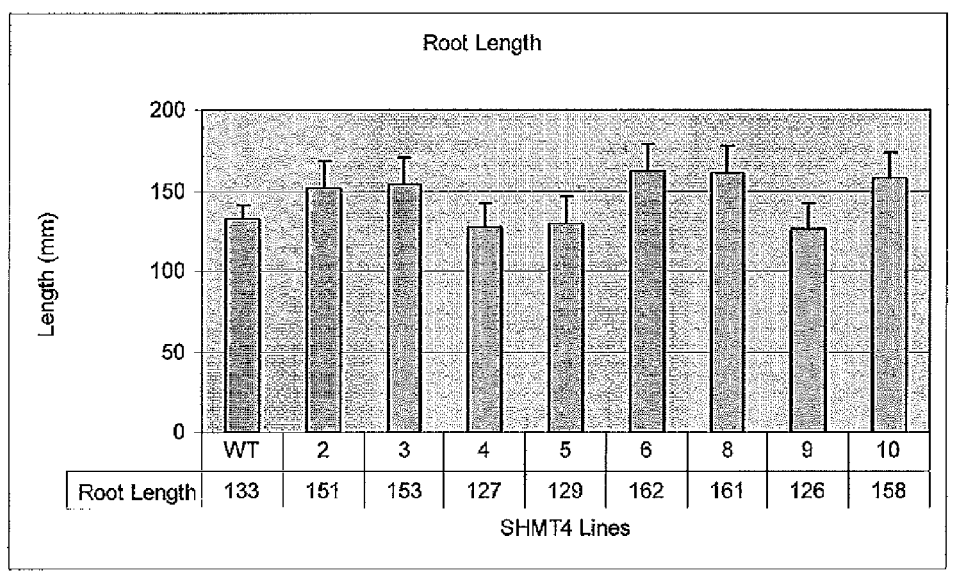

Figure 6

| Gene | Root Length (mm) | Standard | Diff to Control |
|---|---|---|---|
| ID | LSMEAN | Error | P |
| WT | 132.8 | 8.0 | — |
| AtSHMT4 | 146 | 5.9 | 0.4064 |

Figure 7

| Gene | Shoot Dry Weight (g) | Standard | Diff to Control |
|---|---|---|---|
| ID | LSMEAN | Error | P |
| WT | 0.0123 | 0.0013 | — |
| AtSHMT4 | 0.0120 | 0.0010 | 0.9948 |

Figure 8

| Query gene | Tblastn hits (Gene Names) | Tblastn hits (SEQ ID NO) | Identity percentage | Length (aa) |
|---|---|---|---|---|
| AtSHMT(SEQ ID NO:2, 471aa) | BnSHMT4-1 | 136 | 91 | 471 |
| | GmSHMT4-1 | 134 | 86 | 471 |
| | HaSHMT4 | 140 | 84 | 471 |
| | TaSHMT4-1 | 154 | 82 | 306 |
| | ZmSHMT4-1 | 138 | 84 | 427 |
| | LuSHMT4-1 | 150 | 79 | 361 |
| | OsSHMT4-1 | 142 | 56 | 468 |
| | HvSHMT4 | 144 | 57 | 468 |

Figure 9

```
>Contig25369_42492855Dec03 1655bp 42m -
42492855.f_a03_1|Canola|Lib:AC028|clued:5783|varID:12231
        |RTA5656044BF.a.03.1
        Length = 1655

Score =  875 bits (2260), Expect = 0.0
 Identities = 429/471 (91%), Positives = 446/471 (94%)
 Frame = -3

Query: 1     MEPVSSWGNTSLVSVDPEIHDLIEKEKRRQCRGIELIASENFTSFAVIEALGSALTNKYS 60
             M+PVSSWGNT LV+VDPEIHDLIEKEKRRQCRGIELIASENFTSFAVIEALGSALTNKYS
Sbjct: 1635  MDPVSSWGNTPLVTVDPEIHDLIEKEKRRQCRGIELIASENFTSFAVIEALGSALTNKYS 1456

Query: 61    EGIPGNRYYGGNEFIDEIENLCRSRALEAFHCDPAAWGVNVQPYSGSPANFAAYTALLQP 120
             EG+PGNRYYGGNEFID+IENLC+SRALEAF   + A+WGVNVQPYSGSPANFAAYTALLQP
Sbjct: 1455  EGMPGNRYYGGNEFIDQIENLCQSRALEAFRLESASWGVNVQPYSGSPANFAAYTALLQP 1276

Query: 121   HDRIMGLDLPSGGHLTHGYYTSGGKKTSATSIYFESLPYKVNFTTGYIDYDKLEEKALDF 180
             HDRIMGLDLPSGGHLTHGYYTSGGKK SATSIYFESLPYKVNFTTGYIDYDKLEEKA+DF
Sbjct: 1275  HDRIMGLDLPSGGHLTHGYYTSGGKKISATSIYFESLPYKVNFTTGYIDYDKLEEKAMDF 1096

Query: 181   RPKLLICGGSAYPRDWDYARFRAIADKVGALLLCDMAHISGLVAAQEAANPFEYCDVVTT 240
             RPKLLICGGSAYPRDWDYAR RA+ADKVGALLLCDMAHISGLVAAQEAANPFEYCDVVTT
Sbjct: 1095  RPKLLICGGSAYPRDWDYARLRAVADKVGALLLCDMAHISGLVAAQEAANPFEYCDVVTT 916

Query: 241   TTHKSLRGPRAGMIFYRXXXXXXXXXXXXEGAVYDFEDKINFAVFPALQGGPHNHQIGALA 300
             TTHKSLRGPRAGMIFYR            EGAVYDFEDKINFAVFPALQGGPHNHQIGALA
Sbjct: 915   TTHKSLRGPRAGMIFYRKGPKPPKKGQPEGAVYDFEDKINFAVFPALQGGPHNHQIGALA 736

Query: 301   VALKQANTPGFKVYAKQVKANAVALGNYLMSKGYQIVTNGTENHLVLWDLRPLGLTGNKV 360
             VALKQANTPGFKVYAKQVKANAVAL NYLM KGY IVT GTENHLVLWDLRPLGLTGNKV
Sbjct: 735   VALKQANTPGFKVYAKQVKANAVALANYLMGKGYSIVTGGTENHLVLWDLRPLGLTGNKV 556

Query: 361   EKLCDLCSITLNKNAVFGDSSALAPGGVRIGAPAMTSRGLVEKDFEQIGEFLSRAVTLTL 420
             EKLCDLC+ITLNKNAVFGDSSALAPGGVRIG PAMTSRGLVEKDFE IGEFLSR+VTLTL
Sbjct: 555   EKLCDLCNITLNKNAVFGDSSALAPGGVRIGTPAMTSRGLVEKDFEMIGEFLSRSVTLTL 376

Query: 421   DIQKTYGKLLKDFNKGLVNNKDLDQLKADVEKFSASYEMPGFLMSEMKYQD 471
             +IQK +GKLLKDFNKGLVNNK+++LKADVEKFSASYEMPGFLMS MKYQD
Sbjct: 375   NIQKEHGKLLKDFNKGLVNNKEIEELKADVEKFSASYEMPGFLMSAMKYQD 223
```

Figure 10

```
>Contig21207_59789602Dec03 1748bp 22m |
          59789602.f_h12_1|Soybean|Lib:AC090|cluID:3115|varID:4666
          |RTA56564393F.h.12.1
          Length = 1748

Score =  837 bits (2163), Expect = 0.0
 Identities = 407/471 (86%), Positives = 433/471 (91%)
 Frame = +1

Query: 1     MEPVSSWGNTSLVSVDPEIHDLIEKEKRRQCRGIELIASENFTSFAVIEALGSALTNKYS 60
             M+PVS WGNT L +VDPEIHDLIEKEKRRQCRGIELIASENFTSFAVIEALGSALTNKYS
Sbjct: 91    MDPVSVWGNTPLATVDPEIHDLIEKEKRRQCRGIELIASENFTSFAVIEALGSALTNKYS 270

Query: 61    EGIPGNRYYGGNEFIDEIENLCRSRALEAFHCDPAAWGVNVQPYSGSPANFAAYTALLQP 120
             EG+PGNRYYGGNE+ID+IENLCRSRAL+AFH D  +WGVNVQPYSGSPANFAAYTA+L P
Sbjct: 271   EGMPGNRYYGGNEYIDQIENLCRSRALQAFHLDAQSWGVNVQPYSGSPANFAAYTAVLNP 450

Query: 121   HDRIMGLDLPSGGHLTHGYYTSGGKKTSATSIYFESLPYKVNFTTGYIDYDKLEEKALDF 180
             HDRIMGLDLPSGGHLTHGYYTSGGKK SATSIYFESLPYKVN TTGYIDYD+LEEKALDF
Sbjct: 451   HDRIMGLDLPSGGHLTHGYYTSGGKKISATSIYFESLPYKVNSTTGYIDYDRLEEKALDF 630

Query: 181   RPKLLICGGSAYPRDWDYARFRAIADKVGALLLCDMAHISGLVAAQEAANPFEYCDVVTT 240
             RPKL+ICGGSAYPRDWDY RFR +ADK GALLLCDMAH SGLVAAQE +PFEYCD+VTT
Sbjct: 631   RPKLIICGGSAYPRDWDYKRFREVADKCGALLLCDMAHTSGLVAAQEVNSPFEYCDIVTT 810

Query: 241   TTHKSLRGPRAGMIFYRXXXXXXXXXXXXEGAVYDFEDKINFAVFPALQGGPHNHQIGALA 300
             TTHKSLRGPRAGMIFYR            E AVYDFEDKINFAVFP+LQGGPHNHQIGALA
Sbjct: 811   TTHKSLRGPRAGMIFYRKGPKPPKKGQPENAVYDFEDKINFAVFPSLQGGPHNHQIGALA 990

Query: 301   VALKQANTPGFKVYAKQVKANAVALGNYLMSKGYQIVTNCTENHLVLWDLRPLGLTGNKV 360
             VALKQA +PGFK YAKQVKANAVALG YLM KGY +VT GTENHLVLWDLRPLGLTGNKV
Sbjct: 991   VALKQAASPGFKAYAKQVKANAVALGKYLMGKGYSLVTGGTENHLVLWDLRPLGLTGNKV 1170

Query: 361   EKLCDLCSITLNKNAVFGDSSALAPGGVRIGAPAMTSRGLVEKDFEQIGEFLSRAVTLTL 420
             EKLCDLC+IT+NKNAVFGDSSALAPGGVRIGAPAMTSRGLVEKDFEQIGEFL RAVTLTL
Sbjct: 1171  EKLCDLCNITVNKNAVFGDSSALAPGGVRIGAPAMTSRGLVEKDFEQIGEFLHRAVTLTL 1350

Query: 421   DIQKTYGKLLKDFNKGLVNNKDLDQLKADVEKFSASYEMPGFLMSEMKYQD 471
             +IQK +GKLLKDFNKGLVNNK ++ LKADVEKFSA ++MPGFL+SEMKY+D
Sbjct: 1351  EIQKEHGKLLKDFNKGLVNNKAIEDLKADVEKFSALFDMPGFLVSEMKYKD 1503
```

Figure 11

```
>Contig2584_66590840Dec03 1845bp 5m +
66590840.f_117_1|Sunflower|Lib:AC112|cluID:3598|varID:9
          056|RTA57574007F.1.17.1
          Length = 1845

Score =  822 bits (2124), Expect = 0.0
 Identities = 398/471 (84%), Positives = 431/471 (91%)
 Frame = +3

Query: 1    MEPVSSWGNTSLVSVDPEIHDLIEKEKRRQCRGIELIASENFTSFAVIEALGSALTNKYS 60
            M+PV+ WGNT L + DPEI DLIEKEKRRQCRGIELIASENFTSFAVI+ALGS LTNKYS
Sbjct: 348  MDPVNVWGNTPLDAADPEIFDLIEKEKRRQCRGIELIASENFTSFAVIQALGSPLTNKYS 527

Query: 61   EGIPGNRYYGGNEFIDEIENLCRSRALEAFHCDPAAWGVNVQPYSGSPANFAAYTALLQP 120
            EG+PGNRYYGGNE+ID+IENLCRSRAL+A+  DP  WGVNVQPYSGSPANFAAYTALL+P
Sbjct: 528  EGMPGNRYYGGNEYIDQIENLCRSRALQAYRLDPTKWGVNVQPYSGSPANFAAYTALLEP 707

Query: 121  HDRIMGLDLPSGGHLTHGYYTSGGKKTSATSIYFESLPYKVNFTTGYIDYDKLEEKALDF 180
            HDRIMGLDLPSGGHLTHGYYTSGGKK SATSIYFESLPYKVN TTGYIDY+K+EEKALDF
Sbjct: 708  HDRIMGLDLPSGGHLTHGYYTSGGKKISATSIYFESLPYKVNSTTGYIDYEKMEEKALDF 887

Query: 181  RPKLLICGGSAYPRDWDYARFRAIADKVGALLLCDMAHISGLVAAQEAANPFEYCDVVTT 240
            RPKL+ICGGSAYPRDWDY R R IADK GAL+LCDMAHISGLVAAQEAA+PFEYCDVVTT
Sbjct: 888  RPKLIICGGSAYPRDWDYKRIRGIADKCGALMLCDMAHISGLVAAQEAADPFEYCDVVTT 1067

Query: 241  TTHKSLRGPRAGMIFYRXXXXXXXXXXXXEGAVYDFEDKINFAVFPALQGGPHNHQIGALA 300
            TTHKSLRGPRAGMIFYR            E AVYDFEDKINFAVFPALQGGPHNHQIGALA
Sbjct: 1068 TTHKSLRGPRAGMIFYRKGPKPPKKGQPEDAVYDFEDKINFAVFPALQGGPHNHQIGALA 1247

Query: 301  VALKQANTPGFKVYAKQVKANAVALGNYLMSKGYQIVTNGTENHLVLWDLRPLGLTGNKV 360
            VALKQA +PGFK YAKQV+ANAVALGNYLMSK Y++VT GTENHLVLWDLRPLGLTGNKV
Sbjct: 1248 VALKQAMSPGFKAYAKQVRANAVALGNYLMSKDYKLVTGGTENHLVLWDLRPLGLTGNKV 1427

Query: 361  EKLCDLCSITLNKNAVFGDSSALAPGGVRIGAPAMTSRGLVEKDFEQIGEFLSRAVTLTL 420
            EKLCDL +IT+NKNAVFGDSSALAPGGVRIG PAMTSRGLVEKDFEQIGEFL RA+ +TL
Sbjct: 1428 EKLCDLANITVNKNAVFGDSSALAPGGVRIGTPAMTSRGLVEKDFEQIGEFLHRAIQITL 1607

Query: 421  DIQKTYGKLLKDFNKGLVNNKDLDQLKADVEKFSASYEMPGFLMSEMKYQD 471
            IQK +GKLLKDFNKGLVNNK+++QLKADVEKFS S++MPGF +++MKY+D
Sbjct: 1608 SIQKEFGKLLKDFNKGLVNNKEIEQLKADVEKFSGSFDMPGFSLADMKYKD 1760
```

Figure 12

```
>Contig11022_59951309Dec03 1801bp 15m +
         59951309.f_109_1|Wheat|Lib:AC091|cluID:211842|varID:2280
         58|RTA56566039F.1.09.1
         Length = 1801

Score =  522 bits (1345), Expect(2) = 0.0
 Identities = 251/306 (82%), Positives = 279/306 (91%)
 Frame = +3

Query: 166 GYIDYDKLEEKALDFRPKLLICGGSAYPRDWDYARFRAIADKVGALLLCDMAHISGLVAA 225
           GYIDYDKLEEKA+DFRPKL+ICGGSAYPRDWDYAR RA+ADKVGA+LLCDMAHISGLVAA
Sbjct: 585 GYIDYDKLEEKAMDFRPKLIICGGSAYPRDWDYARLRAVADKVGAMLLCDMAHISGLVAA 764

Query: 226 QEAANPFEYCDVVTTTTHKSLRGPRAGMIFYRXXXXXXXXXXXXEGAVYDFEDKINFAVFP 285
           QEAANPFE+CDVVTTTTHKSLRGPRAGMIFYR            EGAVYD+EDKINFAVFP
Sbjct: 765 QEAANPFEFCDVVTTTTHKSLRGPRAGMIFYRKGPKPAKKGQPEGAVYDYEDKINFAVFP 944

Query: 286 ALQGGPHNHQIGALAVALKQANTPGFKVYAKQVKANAVALGNYLMSKGYQIVTNGTENHL 345
           +LQGGPHNHQI ALAVALKQ  TPGFK YAKQVKANAVA+G YLMSKGY++VT+GT+NHL
Sbjct: 945 SLQGGPHNHQIAALAVALKQTLTPGFKAYAKQVKANAVAVGKYLMSKGYKMVTDGTDNHL 1124

Query: 346 VLWDLRPLGLTGNKVEKLCDLCSITLNKNAVFGDSSALPGGVRIGAPAMTSRGLVEKDF 405
           VLWDLRPLGLTGNKVEK+CDLCSITLNKNAVFGDSSAL+PGGVRIGAPAMTSRGLVEKDF
Sbjct: 1125VLWDLRPLGLTGNKVEKMCDLCSITLNKNAVFGDSSALSPGGVRIGAPAMTSRGLVEKDF 1304

Query: 406 EQIGEFLSRAVTLTLDIQKTYGKLLKDFNKGLVNNKDLDQLKADVEKFSASYEMPGFLMS 465
           EQI EFL +AVT+ L+IQK +GKLLKDF+KGLVNNKD++ LK +VEKF+ S++MPGF +
Sbjct: 1305EQIAEFLHQAVTICLNIQKEHGKLLKDFSKGLVNNKDIENLKVEVEKFALSFDMPGFSLE 1484

Query: 466 EMKYQD 471
           MKY++
Sbjct: 1485SMKYKE 1502
```

Figure 13

```
>Contig16225_67030579Dec03 1711bp 7m +
67030579.f_n19_2|Maize|Lib:AC113|cluID:257585|varID:280
          097|RTA56568203F.n.19.2
          Length = 1711

Score =  743 bits (1919), Expect = 0.0
 Identities = 359/427 (84%), Positives = 390/427 (91%)
 Frame = +2

Query: 45   FAVIEALGSALTNKYSEGIPGNRYYGGNEFIDEIENLCRSRALEAFHCDPAAWGVNVQPY 104
            FAV+EALGS LTNKYSEG+PG RYYGGN+ IDEIENLCRSRAL AFH D A+WGVNVQPY
Sbjct: 2    FAVMEALGSGLTNKYSEGMPGARYYGGNDVIDEIENLCRSRALAAFHLDAASWGVNVQPY 181

Query: 105  SGSPANFAAYTALLQPHDRIMGLDLPSGGHLTHGYYTSGGKKTSATSIYFESLPYKVNFT 164
            SGSPANFAAYTALL PHDRIMGLDLPSGGHLTHGYYT+GGKK SATSIYFESLPYKV+
Sbjct: 182  SCSPANFAAYTALLNPHDRIMGLDLPSGGHLTHGYYTAGGKKISATSIYFESLPYKVSAA 361

Query: 165  TGYIDYDKLEEKALDFRPKLLICGGSAYPRDWDYARFRAIADKVGALLLCDMAHISGLVA 224
            TGYIDY+KLEEKALDFRPKL+ICGGSAYPRDWDYA+ RA+ADKVGALLLCDMAHISGLVA
Sbjct: 362  TGYIDYEKLEEKALDFRPKLIICGGSAYPRDWDYAKLRAVADKVGALLLCDMAHISGLVA 541

Query: 225  AQEAANPFEYCDVVTTTTHKSLRGPRAGMIFYRXXXXXXXXXXXXEGAVYDFEDKINFAVF 284
            AQEAANPFEYCDVVTTTTHKSLRGPRAGMIFYR            EGAVYD+EDKINFAVF
Sbjct: 542  AQEAANPFEYCDVVTTTTHKSLRGPRAGMIFYRKGPKPPKKGQPEGAVYDYEDKINFAVF 721

Query: 285  PALQGGPHNHQIGALAVALKQANTPGFKVYAKQVKANAVALGNYLMSKGYQIVTNGTENH 344
            P+LQGGPHNHQI ALAVAL+Q  +PGFK YAKQVKANAVA+GNYLMSKGY++VT+GTENH
Sbjct: 722  PSLQGGPHNHQIAALAVALQQTMSPGFKAYAKQVKANAVAIGNYLMSKGYKMVTDGTENH 901

Query: 345  LVLWDLRPLGLTGNKVEKLCDLCSITLNKNAVFGDSSALAPGGVRIGAPAMTSRGLVEKD 404
            LVLWDLRPLGLTGNKVEKLCDLC ITLNKNAVFGDSSAL+PGGVRIGAPAMTSRGL+EKD
Sbjct: 902  LVLWDLRPLGLTGNKVEKLCDLCHITLNKNAVFGDSSALSPGGVRIGAPAMTSRGLLEKD 1081

Query: 405  FEQIGEFLSRAVTLTLDIQKTYGKLLKDFNKGLVNNKDLDQLKADVEKFSASYEMPGFLM 464
            FEQIGEFL +AVT+ L+IQK YGKLLKDFNKGLVNNKD++ LK  VEKF+ S++MPGF +
Sbjct: 1082 FEQIGEFLHQAVTICLNIQKEYGKLLKDFNKGLVNNKDIENLKVQVEKFADSFDMPGFTL 1261

Query: 465  SEMKYQD 471
            +MKY++
Sbjct: 1262 ESMKYKE 1282
```

Figure 14

```
>Contig11319_61802985LU_Nov03 1186bp 7m +
61802985.f_d23_1|Linseed|Lib:AC097|cluID:8221|varID:119
         05|RTA57570053F.d.23.1
         Length = 1186

Score =  582 bits (1500), Expect = e-166
 Identities = 286/361 (79%), Positives = 305/361 (84%)
 Frame = +1

Query: 1    MEPVSSWGNTSLVSVDPEIHDLIEKEKRRQCRGIELIASENFTSFAVIEALGSALTNKYS 60
            M+PV  WGNT L +VDPEIHDLIEKEKRRQCRGIELIASENFTSFAVIEALGSALTNKYS
Sbjct: 103  MDPVKVWGNTPLQTVDPEIHDLIEKEKRRQCRGIELIASENFTSFAVIEALGSALTNKYS 282

Query: 61   EGIPGNRYYGGNEFIDEIENLCRSRALEAFHCDPAAWGVNVQPYSGSPANFAAYTALLQP 120
            EG+PGNRYYGGNE+ID+IENLC SRAL AFH D   WGVNVQPYSGSPANFAAYTA+L+P
Sbjct: 283  EGMPGNRYYGGNEYIDQIENLCVSRALTAFHLDDTKWGVNVQPYSGSPANFAAYTAILKP 462

Query: 121  HDRIMGLDLPSGGHLTHGYYTSGGKKTSATSIYFESLPYKVNFTTGYIDYDKLEEKALDF 180
            HDRIMGLDLPSGGHLTHGYYTS GKK SATSIYFESLPYKVN +TGYIDYDKLEEKALDF
Sbjct: 463  HDRIMGLDLPSGGHLTHGYYTSSGKKISATSIYFESLPYKVNSSTGYIDYDKLEEKALDF 642

Query: 181  RPKLLICGGSAYPRDWDYARFRAIADKVGALLLCDMAHISGLVAAQEAANPFEYCDVVTT 240
            RP+L+ICGGSAYPRDWDYARFRAIADK GALLLCDMAHISGLVAAQEAANPFE+CD+VTT
Sbjct: 643  RPRLIICGGSAYPRDWDYARFRAIADKCGALLLCDMAHISGLVAAQEAANPFEFCDIVTT 822

Query: 241  TTHKSLRGPRAGMIFYRXXXXXXXXXXXXEGAVYDFEDKINFAVFPALQGGPHNHQIGALA 300
            TTHKSLRGPRAGMIFYR            Y+FED INF+VFPALQG P   +    L
Sbjct: 823  TTHKSLRGPRAGMIFYRKRPKPANKKGQPQGNYEFEDNINFSVFPALQGAPIITRSVPLL 1002

Query: 301  VALKQANTPGFKVYAKQVKANAVALGNYLMSKGYQIVTNGTENHLVLWDLRPLGLTGNKV 360
            +   KQ  P +   KQ K  + L NYLMSKGY +VT GTENHLVLWDLRPLGLTGNKV
Sbjct: 1003 LHXKQGCNPCIQA*PKQXKXKLLLLXNYLMSKGYTLVTGGTENHLVLWDLRPLGLTGNKV 1182

Query: 361  E 361
            E
Sbjct: 1183 E 1185
```

Figure 15

```
>Contig16472_40946184Dec03 2228bp 26m +
         40946184.f_ill_1|Rice|Lib:AC026|cluID:5624|varID:58181|R
         TA56560346F.i.11.1
         Length = 2228

Score =  518 bits (1333), Expect = e-146
 Identities = 263/468 (56%), Positives = 334/468 (71%), Gaps = 5/468 (1%)
 Frame = +1

Query:    9 NTSLVSVDPEIHDLIEKEKRRQCRGIELIASENFTSFAVIEALGSALTNKYSEGIPGNRY   68
            N  L VDPEI D+IE EK RQ +G+ELI SENFTS +V++A+GS +TNKYSEG PG RY
Sbjct:  184 NAPLEEVDPEIADIIEHEKARQWKGLELIPSENFTSVSVMQAVGSVMTNKYSEGYPGARY  363

Query:   69 YGGNEFIDEIENLCRSRALEAFHCDPAAWGVNVQPYSGSPANFAAYTALLQPHDRIMGLD  128
            YGGNE+ID E+LC+ RALEAF  DPA WGVNVQP SGSPANF  YTALL+PH RIM LD
Sbjct:  364 YGGNEYIDMAESLCQKRALEAFRLDPAKWGVNVQPLSGSPANFHVYTALLKPHERIMALD  543

Query:  129 LPSGGHLTHGYYTSGGKKTSATSIYFESLPYKVNFTTGYIDYDKLEEKALDFRPKLLICG  188
            LP GGHL+HGY T  KK SA SI+FE++PY+++ +TG IDYD++E+ A+ FRPKL++ G
Sbjct:  544 LPHGGHLSHGYQTD-TKKISAVSIFFETMPYRLDESTGLIDYDQMEKSAVLFRPKLIVAG  720

Query:  189 GSAYPRDWDYARFRAIADKVGALLLCDMAHISGLVAAQEAANPFEYCDVVTTTTHKSLRG  248
             SAY R +DY R R + DK A+LL DMAHISGLVAA    +PF+Y DVVTTTTHKSLRG
Sbjct:  721 ASAYARLYDYDRMRKVCDKQKAILLADMAHISGLVAAGVVPSPFDYADVVTTTTHKSLRG  900

Query:  249 PRAGMIFYRXXXXXXXXXXXEGAVYDFEDKINFAVFPALQGGPHNHQTGALAVALKQANT  308
            PR  MIFYR           E  +YDFEDKIN AVFP LQGGPHNH I  LAVALKQA T
Sbjct:  901 PRGAMIFYRKGVKGVNKQGKE-VMYDFEDKINAAVFPGLQGGPHNHTITGLAVALKQATT 1077

Query:  309 PGFKVYAKQVKANAVALGNYLMSKGYQIVTNGTENHLVLWDLRPLGLTGNKVEKLCDLCS  368
            P ++ Y +QV +N     L +KGY++V+ GT+NHLVL +L+  G+ G++VEK+  +
Sbjct: 1078 PEYRAYQEQVMSNCAKFAQSLTAKGYELVSGGTDNHLVLVNLKSKGIDGSRVEKVLENVH 1257

Query:  369 ITLNKNAVFGDSSALAPGGVRIGAPAMTSRGLVEKDFEQIGEFLSRAVTLTLDIQKTY-G  427
            I  NKN V GD SA+ PGG+R+G PA+TSRG VE+DF ++ +F   AV L L ++   G
Sbjct: 1258 IAANKNTVPGDVSAMVPGGIRMGTPALTSRGFVEEDFAKVADFFDAAVNLALKVKAAAGG 1437

Query:  428 KLLKDFNKGLVNNKDLD----QLKADVEKFSASYEMPGFLMSEMKYQD  471
            +LKDF  L ++ ++      +L+ DVE+++  +  GF   MKY++
Sbjct: 1438 TKLKDFVATLQSDSNIQSEIAKLRHDVEEYAKQFPTIGFEKETMKYKN 1581
```

Figure 16

```
>Contig9582_64679253Dec03 1943bp 13m +
         64679253.f_b14_1|Barley|Lib:AC106|cluID:37579|varID:4518
         7|RTA57572039F.b.14.1
         Length = 1943

Score =  516 bits (1328), Expect = e-146
 Identities = 267/468 (57%), Positives = 331/468 (70%), Gaps = 5/468 (1%)
 Frame = +2

Query: 9    NTSLVSVDPEIHDLIEKEKRRQCRGIELIASENFTSFAVIEALGSALTNKYSEGIPGNRY  68
            N L VDPEI D+IE EK RQ +G+ELI SENFTS +V++A+GS +TNKYSEG PG RY
Sbjct: 188  NAPLEEVDPEIADIIELEKARQWKGLELIPSENFTSLSVMQAVGSVMTNKYSEGYPGARY 367

Query: 69   YGGNEFIDEIENLCRSRALEAFHCDPAAWGVNVQPYSGSPANFAAYTALLQPHDRIMGLD 128
            YGGNE+ID  E  LC+ RALEAF+ DP  WGVNVQP SGSPANF  YTALL+PHDRIM LD
Sbjct: 368  YGGNEYIDMAETLCQKRALEAFNLDPEKWGVNVQPLSGSPANFHVYTALLKPHDRIMALD 547

Query: 129  LPSGGHLTHGYYTSGGKKTSATSIYFESLPYKVNFTTGYIDYDKLEEKALDFRPKLLICG 188
            LP GGHL+HGY T  KK SA SI+FE++PY+++ +TG IDYD+LE+ A+ FRPKL++ G
Sbjct: 548  LPHGGHLSHGYQTD-TKKISAVSIFFETMPYRLDESTGLIDYDQLEKSAVLFRPKLIVAG 724

Query: 189  GSAYPRDWDYARFRAIADKVGALLLCDMAHISGLVAAQEAANPFEYCDVVTTTTHKSLRG 248
             SAY R +DY R R I DK  A+LL DMAHISGLVAA    +PFEY DVVTTTTHKSLRG
Sbjct: 725  ASAYARLYDYNRMRKICDKQKAVLLADMAHISGLVAAGVIPSPFEYADVVTTTTHKSLRG 904

Query: 249  PRAGMIFYRXXXXXXXXXXXXEGAVYDFEDKINFAVFPALQGGPHNHQIGALAVALKQANT 308
            PR  MIF+R            E  YDFEDKIN AVFP LQGGPHNH    LAVALKQA T
Sbjct: 905  PRGAMIFFRKGVKEINKQGKE-VKYDFEDKINAAVFPGLQGGPHNHTTTGLAVALKQATT 1081

Query: 309  PGFKVYAKQVKANAVALGNYLMSKGYQIVTNGTENHLVLWDLRPLGLTGNKVEKLCDLCS 368
            ++  Y +QV +N+     L SKGY IV+ GT+NHLVL +L+   G+ G++VEK+ +
Sbjct: 1082 QEYRAYQEQVMSNSARFAESLTSKGYDIVSGGTDNHLVLVNLKKKGIDGSRVEKVLENVH 1261

Query: 369  ITLNKNAVFGDSSALAPGGVRIGAPAMTSRGLVEKDFEQIGEFLSRAVTLTLDIQ-KTYG 427
            I  NKN V GD SA+ PGG+R+G PA+TSRG VE+DF ++ EF   AV L L ++    G
Sbjct: 1262 IAANKNTVPGDVSAMVPGGIRMGTPALTSRGFVEEDFAKVAEFFDSAVNLALKVKAAAAG 1441

Query: 428  KLLKDFNKGLVNNKDLD----QLKADVEKFSASYEMPGFLMSEMKYQD 471
             LKDF  L ++ ++    +L+ DVE+++ +  GF   MKY++
Sbjct: 1442 TKLKDFVATLQSDSNIQAEIAKLRHDVEEYAKQFPTIGFEKETMKYKN 1585
```

FIGURE 17-1

```
                1                                                50
AtSHMT4    (1)  --------------------------------------------------
AtSHMT4-2  (1)  --------------------------------------------------
BnSHMT4-2  (1)  --------------------------------------------------
GmSHMT4-1  (1)  --------------------------------------------------
HaSHMT4-1  (1)  ------------------------------------------MLSNVEF
LuSHMT4-1  (1)  --------------------------------------------------
OsSHMT4-2  (1)  --------------------------------------------------
TaSHMT4-1  (1)  --------------------------------------------------
Consensus  (1)

51                                               100
AtSHMT4    (1)  --------------------------------------------------
AtSHMT4-2  (1)  --------------------------------------------------
BnSHMT4-2  (1)  ----------------------MSPVNKFSQQLKFNFAGPNRSLFLK
GmSHMT4-1  (1)  --------------------------------------------------
HaSHMT4-1  (8)  QPQWLQNPPIAECAKTSFCGAHFTIKPLAFISLTKPSGKNSIHSNPLTEP
LuSHMT4-1  (1)  --------------------------------------------------
OsSHMT4-2  (1)  ---------HALCVNVHAARSTEAEAEAGQEVEEEEEXEASSCSSSSSS
TaSHMT4-1  (1)  --------------------------------------------------
Consensus  (51)

101                                              150
AtSHMT4    (1)  -----------------MEPVSSWGNTSLVSVDPEIHDLIEKEKRRQC
AtSHMT4-2  (1)  -----------------MEPVSSWGNTSLVSVDPEIHDLIEKEKRRQC
BnSHMT4-2  (26) EAWSLKGKRLKSRYLPSXTSSNEIPEEDYGRTEVDPEVDELIKKEKNRQF
GmSHMT4-1  (1)  -----------------MDPVSVWGNTPLATVDPEIHDLIEKEKRRQC
HaSHMT4-1  (58) GRTTPNNLSSLYTLLSLDRMDPVNVWGNTPLDAADPEIFDLIEKEKRRQC
LuSHMT4-1  (1)  ------------------MDPVKVWGNTPLQTVDPEIHDLIEKEKRRQC
OsSHMT4-2  (41) LHPAKRQATAERGADLEARRGAVRAWGNQALAEADPDVHALMELERDRQV
TaSHMT4-1  (1)  -----------------MDSVASWGLTPLADADPDVIFDLIEKEKRRQR
Consensus (101)                    MDPVSSWGNTPL  VDPEIHDLIEKEKRRQC 151                                              200
AtSHMT4    (32)  RGIELIASENFTSFAVIEALGSALTNKYSEGIPGNRYYGGNEEIDEIENL
AtSHMT4-2  (32)  RGIELIASENFTSFAVIEALGSALTNKYSEGIPGNRYYGGNEEIDEIENF
BnSHMT4-2  (76)  RSIELIASENFTSRAVMETVGSCLTNKYSEGIPGKRYYGGNEEIDQIETH
GmSHMT4-1  (32)  RGIELIASENFTSFAVIEALGSALTNKYSEGMPGNRYYGGNEYIDQIENL
HaSHMT4-1  (108) RGIELIASENFTSFAVIQALGSPLTNKYSEGMPGNRYYGGNEYIDQIENL
LuSHMT4-1  (32)  RGIELIASENFTSFAVIEALGSALTNKYSEGMPGNRYYGGNEYIDQIENL
OsSHMT4-2  (91)  RGIELIASENFVCRAVIEALGSHLTNKYSEGHPGARYYGGNQIIDGIERI
TaSHMT4-1  (32)  SGIELIASENFTSFAVIEALGSALTNKYSEGMPGARYYGGNDVIDEIENL
Consensus (151)  RGIELIASENFTSFAVIEALGSALTNKYSEGMPGNRYYGGNEYID IENL 201                                              250
AtSHMT4    (82)  GRSRALEAEHCDPAAWGVNVQPYSGSPANFAAYTALLQPHDRIMGLDLPS
AtSHMT4-2  (82)  AVQELSKLSIMIQQR-GALMFSRIRISQKERCLHQFASAVDRIMGLDLPS
BnSHMT4-2  (126) EQNRAIATERLDSTKWGVNVQELSGSPANFAVYTAI--------------
GmSHMT4-1  (82)  GRSRALQAEHLDAQSWGVNVQPYSGSPANFAAYTAVLNPHDRIMGLDLPS
HaSHMT4-1  (158) GRSRALQAYRLDEIKWGVNVQPYSGSPANFAAYTALIEPHDRIMGLDLPS
LuSHMT4-1  (82)  GVSRALTAEHLDDTKWGVNVQPYSGSPANFAAYTALLKPHDRIMGLDLPS
OsSHMT4-2  (141) GHERAIAAEGLDPACWGVNVQPYSCISANLAVYTGLLLEKDRIMGLPPS
TaSHMT4-1  (82)  GRDRALAAERLDAASWGVNVQPYSGSPANFAAYTALLNPHDRIMGLDLPS
Consensus (201)  C  RAL AF LDP KWGVNVQPYSGSPANFAAYTALL PHDRIMGLDLPS 251                                              300
AtSHMT4    (132) GGHLTHGYYTSGGKKISATSIYFESLPYKVNLITGYIDYDKLEEKALDF-
AtSHMT4-2  (131) GGHLTHGYYTSGGKKISATSIYFESLPYKVNFTTGYIDYDKLEEKALDK-
BnSHMT4-2  (162) --------------------------------------------------
GmSHMT4-1  (132) GGHLTHGYYTSGGKKISATSIYFESLPYKVNSITGYIDYDRLEEKALDF-
HaSHMT4-1  (208) GGHLTHGYYTSGGKKISATSIYFESLPYKVNSITGYIDYEKMEEKALDK-
LuSHMT4-1  (132) GGHLTHGYYTSSGKKISATSIYFESLPYKVNSITGYIDYDKLEEKALDF-
OsSHMT4-2  (191) GGHVSHGYYTPSGKKVSQASIFFESLSYKVNPQTGYIDYDRLEERAMDF-
TaSHMT4-1  (132) GGHLTHGYYTAGGKKISATSIYFESLPYKVSXANGYIDYDKLEEKAMDF-
Consensus (251) GGHLTHGYYTSGGKKISATSIYFESLPYKVN TTGYIDYDKLEEKALDF
```

FIGURE 17-2

```
                      301                                                  350
    AtSHMT4   (181)   RPKLLICGGSAYPRDWDYARFRAIADKVGALLLCDMAHISGLVAAQEAAN
    AtSHMT4-2 (180)   RPKLLICGGSAYPRDWDYARFRAIADKVGALLLCDMAHISGLVAAQEAAN
    BnSHMT4-2 (162)   --------------------------------------------------
    GmSHMT4-1 (181)   RPKLIICGGSAYPRDWDYKRFREVADKCGALLLGDMAHTSGLVAAQEVNS
    HaSHMT4-1 (257)   RPKLIICGGSAYPRDWDYKRIRGIADKCGALMLCDMAHISGLVAAQEAAD
    LuSHMT4-1 (181)   RPRLIICGGSAYPRDWDYARFRAIADKCGALLLCDMAHISGLVAAQEAAN
    OsSHMT4-2 (240)   HPKLLICGGSSYPREWDFARMRLIADKCGAVLMQXXAHXXGLVAAXXCRX
    TaSHMT4-1 (181)   RPKLIICGGSAYPRDWDYARLRAVADKVGAMLLCDMAHISGLVAAQEAAN
    Consensus (301)   RPKLIICGGSAYPRDWDYARFRAIADKCGALLLCDMAHISGLVAAQEAAN 351                                                  400
    AtSHMT4   (231)   PFEYCDVVTTTTHKSLRGPRAGMIFYRKGPKPPKK-----GQPEGAVYDF
    AtSHMT4-2 (230)   PFEYCDVXDNHNPQEFEGSKGWYDFLQEGSKTTKK-----GQPEGAVYDF
    BnSHMT4-2 (162)   --------------------------------------------------
    GmSHMT4-1 (231)   PFEYCDLVTTTTHKSLRGPRAGMIFYRKGPKPPKK-----GQPENAVYDF
    HaSHMT4-1 (307)   PFEYCDVVTTTTHKSLRGPRAGMIFYRKGPKPPKK-----GQPEDAVYDF
    LuSHMT4-1 (231)   PFEFCDLVTTTTHKSLRGPRAGMIFYRKRPKPANK-----KGQPQGNYEF
    OsSHMT4-2 (290)   XFXX----------------------------------------------
    TaSHMT4-1 (231)   PFEFCDVVTTTTHKSLRGPRAGMIFYRKGPKPAKK-----GQPEGAVYDY
    Consensus (351)   PFEYCDVVTTTTHKSLRGPRAGMIFYRKGPKP KK     GQPE AVYDF 401                                                  450
    AtSHMT4   (276)   EDKINFAVFPALQGGPHNHQIGALAVALKQANTPGFKVYAKQVKANAVAL
    AtSHMT4-2 (275)   EDKINFAVFPALQGGPHNHQIGALAVALKQANTPGFKVYA----------
    BnSHMT4-2 (162)   --------------------------------------------------
    GmSHMT4-1 (276)   EDKINFAVFPSLQGGPHNHQIGALAVALKQASPGFKAYAKQVKANAVAL
    HaSHMT4-1 (352)   EDKINFAVFPALQGGPHNHQIGALAVALKQAMSPGFKAYAKQVRANAVAL
    LuSHMT4-1 (276)   EDNINFSVFPALQGABIITRSVPHLHXKQGCNFCIQA-------------
    OsSHMT4-2 (294)   --------------------------------------------------
    TaSHMT4-1 (276)   EDKINFAVFPSLQGGPHNHQIAALAVALKQTLTPGFKAYAKQVKANAVAM
    Consensus (401)   EDKINFAVFPALQGGPHNHQIGALAVALKQA TPGFKAYA QVKANA AL 451                                                  500
    AtSHMT4   (326)   GNYLMSKGYQIVTNGTENHLVLWDLRPLGITGNKVEKLCDLCSITLNKNA
    AtSHMT4-2 (315)   --------------------------------------------------
    BnSHMT4-2 (162)   --------------------------------------------------
    GmSHMT4-1 (326)   GKYLMGKGYSLVTGGTENHLVLWDLRPLGITGNKVEKLCDLCNITVNKNA
    HaSHMT4-1 (402)   GNYLMSKDYKLVTGGTENHLVLWDLRPLGITGNKVEKLCDLANITVNKNA
    LuSHMT4-1 (314)   --------------------------------------------------
    OsSHMT4-2 (294)   --------------------------------------------------
    TaSHMT4-1 (326)   GKYLMSKGYKMVTDGTDNHLVLWDLRPLGITGNKVEKNCDLCSITLNKNA
    Consensus (451)   G   K    G   N  R  GL   EKLCD    ITLNK A 501                                                  550
    AtSHMT4   (376)   VFGDSSALAPGGVRIGAPAMTSRGLVEKDFEQIGEFLSRAVTITLDIQKT
    AtSHMT4-2 (315)   --------------------------------------------------
    BnSHMT4-2 (162)   --------------------------------------------------
    GmSHMT4-1 (376)   VFGDSSALAPGGVRIGAPAMTSRGLVEKDFEQIGEFLHRAVTITLEIQKE
    HaSHMT4-1 (452)   VFGDSSALAPGGVRIGTPAMTSRGLVEKDFEQIGEFLHRAIQITLSIQKE
    LuSHMT4-1 (314)   --------------------------------------------------
    OsSHMT4-2 (294)   --------------------------------------------------
    TaSHMT4-1 (376)   VFGDSSALSPGGVRIGAPAMTSRGLVEKDFEQTAEFLHQAVTICLNIQKE
    Consensus (501)   VFGD   L PGGVRIG PAMTSRG VE DFE IGEFL  A  I   IQK
```

FIGURE 17-3

```
              551                                                          600
AtSHMT4    (426) YGKILKDFNKGLVNNKDHDQLRADVEKFSASMFMPGFLMSEMKYKD------
AtSHMT4-2  (315) --------------------------------------------------
BnSHMT4-2  (162) --------------------------------------------------
GmSHMT4-1  (426) HGKILKDFNKGLVNNKAHEDLRADVEKFSALDDMPGFLMSEMKYKD------
HaSHMT4-1  (502) FGKILKDFNKGLVNNKEHEQLRADVEKFSGSEDMPGFSLADMKYKD----
LuSHMT4-1  (314) --------------------------------------------------
OsSHMT4-2  (294) --------------------------------------------------
TaSHMT4-1  (426) HGKILKDFSKGLVNNKDHENLRVEVEKFALSEDMPGFSHESXEVQGEDDD
Consensus  (551)    GKL K  KGL  K I  LK VE FS  F MPGF L 601                                    642
AtSHMT4    (472) ------------------------------------------
AtSHMT4-2  (315) ------------------------------------------
BnSHMT4-2  (162) ------------------------------------------
GmSHMT4-1  (472) ------------------------------------------
HaSHMT4-1  (548) ------------------------------------------
LuSHMT4-1  (314) ------------------------------------------
OsSHMT4-2  (294) ------------------------------------------
TaSHMT4-1  (476) TYVVVVSANRPYAMRFKPSWPPRNATVLCFYEICLLALEPWI
Consensus  (601)
```

YIELD INCREASE IN PLANTS OVEREXPRESSING THE SHSRP GENES

CROSS REFERENCE TO RELATED APPLICATIONS

This application is a continuation of U.S. patent application Ser. No. 11/988,851, filed Jan. 15, 2008 and now abandoned, which is a national stage application (under 35 U.S.C. 371) of PCT/US2006/027384 filed Jul. 13, 2006, which claims the priority benefit of U.S. Provisional Application Serial No. 60/700,267 filed Jul. 18, 2005, the entire contents of each of which is hereby incorporated by reference.

BACKGROUND OF THE INVENTION

1. Field of the Invention

This invention relates generally to nucleic acid sequences encoding polypeptides that are associated with root development, which contribute to plant growth and, ultimately affect plant production (i.e. yield) under abiotic stress or non-stress conditions. In particular, this invention relates to isolated nucleic acid sequences encoding polypeptides that confer upon the plant increased root growth, increased yield, and/or increased drought, cold, and/or salt tolerance, and the use of such isolated nucleic acids.

2. Background Art

The yield of crop plants is central to the well being of humans and is directly affected by the growth of plants under physical environment. Abiotic environmental stresses, such as drought stress, salinity stress, heat stress, and cold stress, are major limiting factors of plant growth and productivity. Crop losses and crop yield losses of major crops such as soybean, rice, maize (corn), cotton, and wheat caused by these stresses represent a significant economic and political factor and contribute to food shortages in many underdeveloped countries.

Plant biomass is the total yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another. Plant size at an early developmental stage will typically correlate with plant size later in development. A larger plant with a greater leaf area can typically absorb more light and carbon dioxide than a smaller plant and therefore will likely gain a greater weight during the same period. This is in addition to the potential continuation of the micro-environmental or genetic advantage that the plant had to achieve the larger size initially. There is a strong genetic component to plant size and growth rate, and so for a range of diverse genotypes plant size under one environmental condition is likely to correlate with size under another. In this way a standard environment is used as a proxy for the diverse and dynamic environments encountered at different locations and times by crops in the field.

Harvest index, the ratio of seed yield to above-ground dry weight, is relatively stable under many environmental conditions and so a robust correlation between plant size and grain yield can often be obtained. These processes are intrinsically linked because the majority of grain biomass is dependent on current or stored photosynthetic productivity by the leaves and stem of the plant. Therefore, selecting for plant size, even at early stages of development, has been used as an indicator for future potential. When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

During the life cycle, plants are typically exposed to conditions of reduced environmental water content. Most plants have evolved strategies to protect themselves against these conditions of desiccation. However, if the severity and duration of the drought conditions are too great, the effects on development, growth, plant size, and yield of most crop plants are profound. Continuous exposure to drought conditions causes major alterations in the plant metabolism which ultimately lead to cell death and consequently yield losses.

Developing stress-tolerant plants is therefore a strategy that has the potential to solve or mediate at least some of these problems. However, traditional plant breeding strategies to develop new lines of plants that exhibit resistance and/or tolerance to these types of stresses are relatively slow and require specific resistant lines for crossing with the desired line. Limited germplasm resources for stress tolerance and incompatibility in crosses between distantly related plant species represent significant problems encountered in conventional breeding. Additionally, the cellular processes leading to drought, cold, and salt tolerance in model drought-, cold-, and/or salt-tolerant plants are complex in nature and involve multiple mechanisms of cellular adaptation and numerous metabolic pathways. This multi-component nature of stress tolerance has not only made breeding for tolerance largely unsuccessful, but has also limited the ability to genetically engineer stress tolerant plants using biotechnological methods.

Therefore, what is needed is the identification of the genes and proteins involved in these multi-component processes leading to increased growth and/or increased stress tolerance. Elucidating the function of genes expressed in stress tolerant plants will not only advance our understanding of plant adaptation and tolerance to environmental stresses, but also may provide important information for designing new strategies for crop improvement.

Roots are an important organ of higher plants. Plant root systems are fundamental to the proper growth and development of all terrestrial plant species. In addition to uptake of water and nutrients and providing physical support, roots mediate a complex but poorly understood exchange of communication between soil microbes and other plants. In agronomic systems, production is impacted by the availability of water and nutrients in the soil: root growth has a direct or indirect influence on growth and yield of aerial organs, particularly under conditions of nutrient limitation. Roots are also relevant for the production of secondary plant products, such as defense compounds and plant hormones. Establishment of proper root architecture is an important factor for the plant to effectively use the water and nutrients available in the environment and to maximize plant growth and production. In addition, under conditions of drought, roots can adapt to continue growth while at the same time producing and sending early warning signals to shoots which inhibit plant growth above ground.

Moreover, improved root growth of crop plants will also enhance competitiveness with weedy plants and will improve growth in arid areas, by increasing water accessibility and uptake. Improved root growth is also relevant for ecological purposes, such as bioremediation and prevention/arrest of soil erosion. Longer roots can alleviate not only the effects of water depletion from soil but also improve plant anchorage and standability thus reducing lodging. Also, longer roots have the ability to cover a larger volume of soil and improve nutrient uptake. Therefore, altering root biomass, and in particular increasing root length, will improve plant growth as well as increase crop yield.

Roots are also storage organs in a number of important staple crops, for example, in sugar beets, potato, manioc (cassava), yams and sweet potato (batate). Roots are also the relevant organ for consumption in a number of vegetables (e.g. carrots, radish), herbs (e.g. ginger, kukuma) and medicinal plants (e.g. ginseng). In addition, some of the secondary plant products found in roots are of economic importance for the chemical and pharmaceutical industry, for instance, the basic molecules for the synthesis of steroid hormones is found in yams, and the roots of *Lithospermum erythrorhizon* produce shikonin, which is widely used because of its anti-inflammatory, anti-tumor and wound-healing properties.

Root architecture is an area that has remained largely unexplored through classical breeding because of difficulties with assessing this trait in the field. Thus, biotechnology could have significant impact on the improvement of this trait.

The structure of root systems results from a combination of genetic predisposition and physical environment. Several root mutants have been isolated from the model plant *Arabidopsis thaliana* and several crop species that have gleaned some insight into root growth and development. Additionally, genes involved in photorespiratory pathway can also have a beneficial effect on plant growth, such as by improving the fixation of $CO_2$ during photosynthesis to increase the production of nutrients and to promote plant growth.

In plants, serine hydroxymethyltransferase (SHMT) plays a role in photorespiratory pathway in addition to its involvement in metabolic pathway. In serine biosynthesis, SHMT catalyses the reversible conversion of serine and tetra hydrfolate (THF) to glycine and $N^5,N^{10}$-methylene THF, an essential step in primary metabolism. In *E. coli*, 15% of all carbon atoms derived from glucose pass through the glycine-serine pathway. In eukaryotes, SHMT activity in glycine-serine interconversion is a major source of one-carbon units for such biosynthetic processes as methionine, pyrimidine and purine biosynthesis. Additionally, serine and glycine are precursors for chlorophyll, glutathione, and phospholipids. Because of its importance in primary metabolism, plants are not able to perform oxygenic photosynthesis without SHMT, and reductions in SHMT activity leads to deleterious growth defects.

In *Arabidopsis*, seven SHMT genes are known (AtSHMT1-AtSHMT7). Unlike the other AtSHMTs, AtSHMT4 is maximally expressed in roots and is not induced by light. Additionally, it is shown that the expression of AtSHMT4 is regulated by a circadian clock (McClung et al., 2000, Plant Physiology 123:381-392; Ho et al., 1999, Journal of Biological Chemistry 274:11007-11012).

Although some genes that are involved in stress responses in plants have been characterized, the characterization and cloning of plant genes that confer stress tolerance remains largely incomplete and fragmented. For example, certain studies have indicated that drought and salt stress in some plants may be due to additive gene effects, in contrast to other research that indicates specific genes are transcriptionally activated in vegetative tissue of plants under osmotic stress conditions. Although it is generally assumed that stress-induced proteins have a role in tolerance, direct evidence is still lacking, and the functions of many stress-responsive genes are unknown.

There is a need, therefore, to identify additional genes expressed in stress tolerant plants that have the capacity to confer increased root growth, and/or increased yield, and/or stress tolerance to its host plant and to other plant species. Newly generated stress tolerant plants will have many advantages, such as an increased range in which the crop plants can be cultivated by, for example, decreasing the water requirements of a plant species.

SUMMARY OF THE INVENTION

This invention relates to isolated nucleic acids which encode polypeptides capable of modulating root growth, and/or plant growth, and/or yield, and/or stress tolerance under normal or stress conditions as compared to a wild type variety of the plant. In particular, the invention concerns the use of the isolated nucleic acids encode Serine Hydroxymethyltransferase-like Protein Stress-Related Polypeptides (SHSRPs) that are important for modulating a plant's root growth, yield, and/or response to an environmental stress. More particularly, overexpression of these SHSRP coding nucleic acids in a crop plant results in increased root growth, and/or increased yield under normal or stress conditions, and/or increased tolerance to an environmental stress.

Therefore, in a first embodiment, the invention concerns a transgenic crop plant transformed with an isolated nucleic acid, wherein the nucleic acid comprises a polynucleotide selected from the group consisting of:

a) a polynucleotide having a sequence as set forth in any of SEQ ID NOS as provided in Column No. 3 of Table 1 and Table 2;

b) a polynucleotide encoding a polypeptide having a sequence as set forth in any of SEQ ID NOS as provided in Column No. 4 of Table 1 and Table 2;

c) a polynucleotide having at least 70% sequence identity to a polynucleotide having a sequence as set forth in any of SEQ ID NOS as provided in Column No. 3 of Table 1 and Table 2;

d) a polynucleotide encoding a polypeptide having at least 70% sequence identity to a polypeptide having a sequence as set forth in any of SEQ ID NOS as provided in Column No. 4 of Table 1 and Table 2; and e) a polynucleotide that hybridizes under stringent conditions to the complement of any of the polynucleotides of a) through d) above.

Preferably, the transgenic crop plant expresses such isolated nucleic acid, so as preferably to alter the phenotype of the plants in relation to non-transformed, wild-type plants. In particular, the transgenic crop plants will exhibit modulated root growth (preferably, increased root growth), and/or plant growth, and/or yield, and/or stress tolerance under normal or stress conditions as compared to a wild type variety of the plant. Preferably, the SHSRP is from *Arabidopsis thaliana*, canola, soybean, rice, sunflower, barley, wheat, linseed or maize. Namely, described herein are the *Arabidopsis thaliana* serine hydroxymethyltransferase 4 genes (AtSHMT4 and AtSHMT4-2), and homologs thereof in canola, soybean, rice, sunflower, barley, wheat, linseed, and maize.

In another embodiment, the invention concerns transgenic crop plants which overexpress the SHSRP coding nucleic acid and demonstrate an increase in root growth, and more preferably, demonstrate an increase in root length under normal or stress condition as compared to a wild type variety of the plant. In one embodiment, the overexpression of the SHSRP coding nucleic acid in the plant demonstrates an increased tolerance to an environmental stress as compared to a wild-type variety of the plant. In yet another embodiment, the overexpression of the SHSRP coding nucleic acid in the plant demonstrates increased yield as compared to a wild-type variety of the plant. It is provided that the environmental stress can be salinity, drought, temperature, metal, chemical, pathogenic and oxidative stresses, or combinations thereof. Preferably, the environmental stress is drought stress.

In yet another embodiment, the invention concerns a seed produced by a transgenic crop plant transformed by an SHSRP coding nucleic acid, wherein the plant is true breeding for increased root growth, and/or increased yield, and/or increased tolerance to environmental stress as compared to a wild type variety of the plant.

In a further embodiment, the invention concerns a method of growing crop plants in an agricultural locus, wherein the method comprises obtaining the aforesaid transgenic crop plant and growing the plant in an agricultural locus.

In a still further aspect, the invention concerns product produced by or from the transgenic plants, their plant parts, or their seeds, such as a foodstuff, feedstuff, food supplement, feed supplement, cosmetic or pharmaceutical.

In another embodiment, the invention concerns a method of increasing root growth and/or yield, and/or increasing stress tolerance to an environmental stress of a crop plant under normal or stress condition as compared to a wild type variety of the plant, wherein the method comprises obtaining the aforesaid transgenic crop plant and growing the plant under a condition that the isolated nucleic acid is expressed.

In yet another embodiment, the invention concerns a method of producing the aforesaid transgenic crop plant, wherein the method comprises (a) transforming a plant cell with an expression vector comprising an SHSRP coding nucleic acid, and (b) generating from the plant cell the transgenic crop plant that expresses the encoded polypeptide. Preferably, the polynucleotide is operably linked to one or more regulatory sequences, and the expression of the polynucleotide in the plant results in increased root growth, and/or increased yield, and/or increased tolerance to environmental stress under normal or stress conditions as compared to a wild type variety of the plant. Preferably, the one or more regulatory sequences include a promoter. More preferably, the promoter is a tissue specific or developmental regulated promoter.

In a further embodiment, the invention concerns an isolated, novel SHSRP coding nucleic acid, wherein the nucleic acid comprising a polynucleotide selected from the group consisting of:

a) a polynucleotide having a sequence as set forth in any of SEQ ID NOS as provided in Column No. 3 of Table 2;

b) a polynucleotide encoding a polypeptide having a sequence as set forth in any of SEQ ID NOS as provided in Column No. 4 of Table 2;

c) a polynucleotide having at least 90% sequence identity to a polynucleotide having a sequence as set forth in any of SEQ ID NOS as provided in Column No. 3 of Table 2;

d) a polynucleotide encoding a polypeptide having at least 92% sequence identity to a polypeptide having a sequence as set forth in any of SEQ ID NOS as provided in Column No. 4 of Table 2;

e) a polynucleotide that hybridizes under stringent conditions to the complement of any of the polynucleotides of a) through d) above; and f) a polynucleotide complementary to any of the polynucleotides of a) through d) above.

In another embodiment, the invention concerns a transgenic plant transformed with such isolated nucleic acids, and a seed produced by such transgenic plant. Preferably, the transgenic plant expresses such isolated nucleic acids, so as preferably to alter the phenotype of the plants in relation to non-transformed, wild-type plants. In particular, the transgenic plant will exhibit modified (preferably, increased) root growth, and/or plant growth, and/or yield, and/or stress tolerance under normal or stress conditions as compared to a wild type variety of the plant.

In still another embodiment, the invention concerns a recombinant expression vector comprising an isolated SHSRP coding nucleic acid, wherein the nucleic acid comprises a polynucleotide selected from the group consisting of:

a) a polynucleotide having a sequence as set forth in any of SEQ ID NOS as provided in Column No. 3 of Table 1 and Table 2;

b) a polynucleotide encoding a polypeptide having a sequence as set forth in any of SEQ ID NOS as provided in Column No. 4 of Table 1 and Table 2;

c) a polynucleotide having at least 90% sequence identity to a polynucleotide having a sequence as set forth in any of SEQ ID NOS as provided in Column No. 3 of Table 1 and Table 2;

d) a polynucleotide encoding a polypeptide having at least 92% sequence identity to a polypeptide having a sequence as set forth in any of SEQ ID NOS as provided in Column No. 4 of Table 1 and Table 2;

e) a polynucleotide that hybridizes under stringent conditions to the complement of any of the polynucleotides of a) through d) above; and f) a polynucleotide complementary to any of the polynucleotides of a) through d) above.

Preferably, the polynucleotide is operably linked to one or more regulatory sequences. More preferably, the one or more regulatory sequences include a promoter. Further preferably, the promoter is a tissue specific or developmental regulated promoter.

In a further embodiment, the invention concerns a transgenic plant comprising such recombinant vector. Preferably, the expression of the SHSRP coding nucleic acid in the plant results in increased root growth, and/or increased yield, and/or increased tolerance to environmental stress as compared to a wild type variety of the plant.

In yet another embodiment, the invention concerns a method of identifying a novel SHSRP, comprising (a) raising a specific antibody response to an SHSRP, or fragment thereof, as described below; (b) screening putative SHSRP material with the antibody, wherein specific binding of the antibody to the material indicates the presence of a potentially novel SHSRP; and (c) identifying from the bound material a novel SHSRP in comparison to known SHSRP. Alternatively, hybridization with nucleic acid probes as described below can be used to identify novel SHSRP nucleic acids.

In a further embodiment, the invention also concerns methods of modifying the root growth, and/or yield, and/or stress tolerance of a plant comprising, modifying the expression of an SHSRP coding nucleic acid in the plant. Preferably, such modification results in increased or decreased root growth, and/or yield, and/or stress tolerance as compared to a wild type variety of the plant. Preferably, the root growth, and/or yield, and/or stress tolerance is increased in a plant via increasing expression of an SHSRP coding nucleic acid.

BRIEF DESCRIPTION OF THE DRAWINGS

FIG. 1 shows the nucleotide sequence of the AtSHMT4 gene (SEQ ID NO:1; At4g13930) used for *Arabidopsis* transformation. The coding region of the gene is 1416 bp in length with the start codon (i.e. ATG) and the stop codon (i.e. TAG) underlined.

FIG. 2 shows the predicted 471 amino acid sequence of the AtSHMT4 gene used for *Arabidopsis* transformation (SEQ ID NO:2).

FIG. 3 shows a schematic of the binary vector T-DNA used to transform the AtSHMT4 gene (SEQ ID NO:1). LB, left border; pAHAS, *Arabidopsis* AHAS promoter, 3'AHAS, AHAS termination signal; SP, Superpromoter; AtSHMT4, cDNA of AtSHMT4 (SEQ ID NO:1); 3'NOS, termination signal; RB, Right Border.

FIGS. 4A and 4B show a plate analysis of the *Arabidopsis* AtSHMT4 (SEQ ID NO:1) transgenic plants. 4A demonstrates that all lines showed an increased root length phenotype. Lines 3, 6, 7, 8, and 9 showed a more significant root length increase compared to the wild type controls. 4B shows the gene level analysis of the AtSHMT4 transgenic plants, confirming that AtSHMT4 plants exhibited an increased root length phenotype. In both 4A and 4B the attached tables show the actual mean values used to generate the bar charts.

FIG. 5 shows the in soil analysis of roots of the AtSHMT4 (SEQ ID NO: 1) plants, where the root length of AtSHMT4 *Arabidopsis* lines was measured.

FIG. 6 shows the gene level ANOVA analysis of the AtSHMT4 (SEQ ID NO:1) transgenic plants. The analysis data of all transgenic lines was combined to determine the overall gene performance.

FIG. 7 shows the gene level ANOVA analysis of rosette dry weights in the AtSHMT4 (SEQ ID NO:1) transgenic plants.

FIG. 8 shows the tblastn analysis results of AtSHMT4 (SEQ ID NO:2) against the proprietary crop sequence databases. The table shows the sequence identity percentage between the amino acid sequences of AtSHMT4 (SEQ ID NO:2) and BnSHMT4-1 (SEQ ID NO:136), GmSHMT4-1 (SEQ ID NO:134), HaSHMT4 (SEQ ID NO:140), TaSHMT4-1 (SEQ ID NO:154), ZmSHMT4-1 (SEQ ID NO:138), LuSHMT4-1 (SEQ ID NO:150), OsSHMT4-1 (SEQ ID NO:142), or HvSHMT4 (SEQ ID NO:144).

FIG. 9 shows the Blast alignment between the amino acid sequences of AtSHMT4 (SEQ ID NO:2, "Query") and BnSHMT4-1 (SEQ ID NO:136, "Sbjct").

FIG. 10 shows the Blast alignment between the amino acid sequences of AtSHMT4 (SEQ ID NO:2, "Query") and GmSHMT4-1 (SEQ ID NO:134, "Sbjct").

FIG. 11 shows the Blast alignment between the amino acid sequences of AtSHMT4 (SEQ ID NO:2, "Query") and HaSHMT4 (SEQ ID NO: 140, "Sbjct").

FIG. 12 shows the Blast alignment between the amino acid sequences of AtSHMT4 (SEQ ID NO:2, "Query") and TaSHMT4-1 (SEQ ID NO:154, "Sbjct").

FIG. 13 shows the Blast alignment between the amino acid sequences of AtSHMT4 (SEQ ID NO:2, "Query") and ZmSHMT4-1 (SEQ ID NO: 138, "Sbjct").

FIG. 14 shows the Blast alignment between the amino acid sequences of AtSHMT4 (SEQ ID NO:2, "Query") and LuSHMT4-1 (SEQ ID NO:150, "Sbjct").

FIG. 15 shows the Blast alignment between the amino acid sequences of AtSHMT4 (SEQ ID NO:2, "Query") and OsSHMT4-1 (SEQ ID NO:142, "Sbjct").

FIG. 16 shows the Blast alignment between the amino acid sequences of AtSHMT4 (SEQ ID NO:2, "Query") and HvSHMT4 (SEQ ID NO: 144, "Sbjct").

FIG. 17 shows an alignment of the amino acid sequences of AtSHMT4 (SEQ ID NO:2), AtSHMT4-2 (SEQ ID NO:146), BnSHMT4-2 (SEQ ID NO:148), OmSHMT4-1 (SEQ ID NO:134), HaSHMT4-1 (SEQ ID NO:152), LuSHMT4-1 (SEQ ID NO:150), OsSHMT4-2 (SEQ ID NO:155), and TaSHMT4-1 (SEQ ID NO:154). Consensus sequence (SEQ ID NO:156) is also provided.

DETAILED DESCRIPTION OF THE INVENTION

The present invention may be understood more readily by reference to the following detailed description of the preferred embodiments of the invention and the Examples included herein. However, before the present compounds, compositions, and methods are disclosed and described, it is to be understood that this invention is not limited to specific nucleic acids, specific polypeptides, specific cell types, specific host cells, specific conditions, or specific methods, etc., as such may, of course, vary, and the numerous modifications and variations therein will be apparent to those skilled in the art. It is also to be understood that the terminology used herein is for the purpose of describing specific embodiments only and is not intended to be limiting. In particular, the designation of the amino acid sequences as polypeptide "Serine Hydroxymethyltransferase-like Stress-Related Polypeptides" (SHSRPs), in no way limits the functionality of those sequences.

The present invention relates to SHSRPs and SHSRP coding nucleic acids that are important in increasing plant root growth, and/or yiled, and/or for modulating a plant's response to an environmental stress. More particularly, overexpression of these SHSRP coding nucleic acids in a crop plant results in modulation (increase or decrease, preferably increase) in root growth, and/or increased yield, and/or increased tolerance to an environmental stress. Representative members of the SHSRP genus are AtSHMT4 isolated from *Arabidopsis thaliana*, and the full-length homologs isolated from canola, soybean, sunflower, maize, rice, linseed, and barley. In a preferred embodiment, all members of the genus are biologically active serine hydroxymethyltransferases.

Accordingly, the present invention encompasses a transgenic crop plant comprising SHSRP polynucleotide and polypeptide sequences and a method of producing such transgenic crop plant, wherein the expression of the SHSRP polypeptide in the plant results in increased root growth, and/or yield, and/or tolerance to an environmental stress. In one embodiment, the SHSRP sequences are from a plant, preferably an *Arabidopsis* plant, a canola plant, a soybean plant, a rice plant, a sunflower plant, a barley plant, linseed plant, or a maize plant. In another embodiment, the SHSRP sequences are the genes as summarized in Table 1 and Table 2. Preferably, the disclosed SHSRP sequences have significant percent identity to known serine hydroxymethyltransferases.

TABLE 1

SHSRP genes, their origin, nucleotide sequence and corresponding amino acid sequence, and their percentage of identity shared with AtSHMT4 (SEQ ID NO: 2) at the amino acid level (Needleman-Wunsch algorithm for global sequence alignment, J. Mol. Biol. 48(3):443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtSHMT4 (%) |
|---|---|---|---|---|
| AtSHMT4 | Arabidopsis thaliana | 1 | 2 | 100 |
| BPS_WIPO_PROT|SL000003.38777 | Arabidopsis thaliana | 3 | 4 | 51 |
| BPS_WIPO_PROT|SL000003.38778 | Arabidopsis thaliana | 5 | 6 | 40 |
| BPS_WIPO_PROT|SL000003.41408 | Zea mays | 7 | 8 | 53 |
| BPS_WIPO_PROT|SL000004.54799 | Zea mays | 9 | 10 | 85 |
| BPS_WIPO_PROT|SL000004.54800 | Zea mays | 11 | 12 | 78 |
| BPS_WIPO_PROT|SL000004.62531 | Arabidopsis thaliana | 13 | 14 | 50 |
| BPS_WIPO_PROT|SL000004.62532 | Arabidopsis thaliana | 15 | 16 | 52 |
| BPS_WIPO_PROT|US200040031072A1.150844 | Glycine max | 17 | 18 | 50 |
| BPS_WIPO_PROT|US200040031072A1.172544 | Glycine max | 19 | 20 | 51 |
| BPS_WIPO_PROT|US200040031072A1.233276 | Glycine max | 21 | 22 | 75 |
| BPS_WIPO_PROT|US200040123343A1.119577 | Oryza sativa | 23 | 24 | 74 |
| BPS_WIPO_PROT|US200040123343A1.119579 | Oryza sativa | 25 | 26 | 84 |
| BPS_WIPO_PROT|US200040123343A1.126627 | Oryza sativa | 27 | 28 | 46 |
| BPS_WIPO_PROT|US200040123343A1.142189 | Oryza saliva | 29 | 30 | 72 |
| BPS_WIPO_PROT|US200040172684A1.46655 | Sorghum bicolor | 31 | 32 | 85 |
| BPS_WIPO_PROT|US200040214272A1.277992 | Zea mays | 33 | 34 | 53 |
| BPS_WIPO_PROT|US200040214272A1.282298 | Zea mays | 35 | 36 | 77 |
| BPS_WIPO_PROT|US200040214272A1.282300 | Zea mays | 37 | 38 | 76 |
| BPS_WIPO_PROT|US200040216190A1.6295 | Arabidopsis thaliana | 39 | 40 | 49 |
| AAB96693 | Pyrococcus abyssi | 41 | 42 | 27 |
| AAR57434 | Hyphomicrobium methylovorum | 43 | 44 | 40 |
| AAR97745 | Brevibacterium flavum | 45 | 46 | 35 |
| AAU34661 | Escherichia coli | 47 | 48 | 40 |
| AAU35234 | Enterococcus faecalis | 49 | 50 | 39 |
| AAU35551 | Haemophilus influenzae | 51 | 52 | 38 |
| AAU36441 | Pseudomonas aeruginosa | 53 | 54 | 40 |
| AAU37742 | Streptococcus pneumoniae | 55 | 56 | 36 |
| AAU38199 | Salmonella typhi | 57 | 58 | 40 |
| AAY35143 | Chlamydophila pneumoniae | 59 | 60 | 28 |
| AAY37798 | Chlamydia trachomatis | 61 | 62 | 29 |
| AAY96286 | Sinorhizobium meliloti | 63 | 64 | 42 |
| ABB47862 | Listeria monocytogenes | 65 | 66 | 40 |
| ABB53911 | Lactococcus lactis | 67 | 68 | 40 |
| ABG93870 | Triticum aestivum | 69 | 70 | 52 |
| ABO65138 | Klebsiella pneumoniae | 71 | 72 | 40 |
| ABP81584 | Streptococcus pneumoniae | 73 | 74 | 36 |
| ABR52682 | Saccharomyces cerevisiae | 75 | 76 | 41 |

TABLE 1-continued

SHSRP genes, their origin, nucleotide sequence and corresponding amino acid sequence, and their percentage of identity shared with AtSHMT4 (SEQ ID NO: 2) at the amino acid level (Needleman-Wunsch algorithm for global sequence alignment, J. Mol. Biol. 48(3):443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtSHMT4 (%) |
|---|---|---|---|---|
| ABR52721 | Saccharomyces cerevisiae | 77 | 78 | 51 |
| ABU19281 | Borrelia burgdorferi | 79 | 80 | 40 |
| ABU23797 | Clostridium acetobutylicum | 81 | 82 | 38 |
| ABU26386 | Campylobacter jejuni | 83 | 84 | 42 |
| ABU27337 | Chlamydia trachomatis | 85 | 86 | 31 |
| ABU36056 | Mycobacterium leprae | 87 | 88 | 39 |
| ABU36417 | Mycobacterium tuberculosis | 89 | 90 | 39 |
| ABU37961 | Neisseria meningitidis | 91 | 92 | 38 |
| ABU39008 | Pasteurella multocida | 93 | 94 | 39 |
| ABU46642 | Streptococcus pyogenes | 95 | 96 | 38 |
| ABU47864 | Salmomella typhi | 97 | 98 | 40 |
| ABU49679 | Vibrio cholerae | 99 | 100 | 40 |
| ABU50551 | Yersinia pestis | 101 | 102 | 37 |
| ADB08638 | Alloiococcus otitis | 103 | 104 | 41 |
| ADG25629 | Nicotiana tabacum | 105 | 106 | 51 |
| ADH48636 | Staphylococcus aureus | 107 | 108 | 39 |
| ADK47199 | Streptococcus pneumoniae | 109 | 110 | 36 |
| ADS04590 | Staphylococcus epidermidis | 111 | 112 | 38 |
| ADS14964 | Pseudomonas aeruginosa | 113 | 114 | 40 |
| ADS15111 | Pseudomonas aeruginosa | 115 | 116 | 40 |
| ADV81271 | Streptococcus agalactiae | 117 | 118 | 38 |
| AEB39867 | Legionella pneumophila | 119 | 120 | 41 |

TABLE 2

Novel SHSRP genes, their origin, nucleotide sequence and corresponding amino acid sequence, and their percentage of identity shared with AtSHMT4 (SEQ ID NO: 2) at the amino acid level (Needleman-Wunsch algorithm for global sequence alignment, J. Mol. Biol. 48(3):443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtSHMT4 (%) |
|---|---|---|---|---|
| OsSHMT4-3 (40946184_singleclone) | Oryza sativa | 121 | 122 | 52 |
| BnSHMT4-3 (45110082_singlecloneDLM) | Brassica napus | 123 | 124 | 52 |
| BnSHMT4-4 (51353481_singleclone) | Brassica napus | 125 | 126 | 52 |
| BnSHMT4-5 (51353481_singlecloneDLM) | Brassica napus | 127 | 128 | 51 |
| LuSHMT4-2 (61819073_singleclone) | Linum usitatissimum | 129 | 130 | 55 |
| ZmSHMT4-2 (61987393_singleclone) | Zea mays | 131 | 132 | 85 |
| GmSHMT4-1 | Soybean | 133 | 134 | — |
| BnSHMT4-1 | Brassica napus | 135 | 136 | — |
| ZmSHMT4-1 | Zea mays | 137 | 138 | — |
| HaSHMT4 | Sunflower | 139 | 140 | — |

TABLE 2-continued

Novel SHSRP genes, their origin, nucleotide sequence and corresponding amino acid sequence, and their percentage of identity shared with AtSHMT4 (SEQ ID NO: 2) at the amino acid level (Needleman-Wunsch algorithm for global sequence alignment, J. Mol. Biol. 48(3):443-53; Matrix: Blosum 62; Gap opening penalty: 10.0; Gap extension penalty: 2.0).

| Column No. 1<br>Gene Name | Column No. 2<br>Organism | Column No. 3<br>Nucleotide<br>SEQ ID NO: | Column No. 4<br>Amino acide<br>SEQ ID NO: | Column No. 5<br>Identity to<br>AtSHMT4 (%) |
|---|---|---|---|---|
| OsSHMT4-1 | *Oryza sativa* | 141 | 142 | — |
| HvSHMT4 | Barley | 143 | 144 | — |
| AtSHMT4-2 | *Arabidopsis thaliana* | 145 | 146 | — |
| BnSHMT4-2 | *Brassica napus* | 147 | 148 | — |
| LuSHMT4-1 | *L. usitatissimum* | 149 | 150 | — |
| HaSHMT4-1 | *H. annuus* | 151 | 152 | — |
| TaSHMT4-1 | *T. aestivum* | 153 | 154 | — |
| OsSHMT4-2 | *Oryza sativa* |  | 155 | — |

The present invention further encompasses novel SHSRP polynucleotide and polypeptide sequences and their use for increasing a plant's root growth, and/or yield, and/or tolerance to an environmental stress. In this embodiment, the SHSRP sequences are from *Arabidopsis*, canola, soybean, rice, sunflower, barley, linseed or maize, or homologous thereto. Preferably in this embodiment, the SHSRP polynucleotide and polypeptide sequences are those from *Arabidopsis*, canola, soybean, rice, sunflower, barley, linseed, or maize as set forth in any of SEQ ID NOS as provided in Column Nos. 3 and 4 of Table 2.

The present invention provides a transgenic plant transformed by an SHSRP coding nucleic acid, wherein expression of the nucleic acid sequence in the plant results in increased root growth, and/or increased yield, and/or increased tolerance to an environmental stress as compared to a wild type variety of the plant. In particular, the increased root growth is an increase in the length of the roots. The term "plant" as used herein can, depending on context, be understood to refer to whole plants, plant cells, and plant parts including seeds. The word "plant" also refers to any plant, particularly to seed plant, and may Include, but not limited to, crop plants. Plant parts include, but are not limited to, stems, roots, ovules, stamens, leaves, embryos, meristematic regions, callus tissue, gametophytes, sporophytes, pollen, microspores, and the like. In one embodiment, the transgenic plant is male sterile. Also provided is a plant seed produced by a transgenic plant transformed by an SHSRP coding nucleic acid, wherein the seed contains the SHSRP coding nucleic acid, and wherein the plant is true breeding for increased root growth, and/or increased yield, and/or increased tolerance to environmental stress as compared to a wild type variety of the plant. The invention further provides a seed produced by a transgenic plant expressing an SHSRP, wherein the seed contains the SHSRP, and wherein the plant is true breeding for increased root growth, and/or increased yield, and/or increased tolerance to environmental stress as compared to a wild type variety of the plant. The invention also provides a product produced by or from the transgenic plants expressing the SHSRP coding nucleic acid, their plant parts, or their seeds. The product can be obtained using various methods well known in the art. As used herein, the word "product" includes, but not limited to, a foodstuff, feedstuff, a food supplement, feed supplement, cosmetic or pharmaceutical. Foodstuffs are regarded as compositions used for nutrition. These also include compositions for supplementing nutrition. Animal feedstuffs and animal feed supplements, in particular, are regarded as foodstuffs. The invention further provides an agricultural product produced by any of the transgenic plants, plant parts, and plant seeds. Agricultural products include, but are not limited to, plant extracts, proteins, amino acids, carbohydrates, fats, oils, polymers, vitamins, and the like.

As used herein, the term "variety" refers to a group of plants within a species that share constant characters that separate them from the typical form and from other possible varieties within that species. While possessing at least one distinctive trait, a variety is also characterized by some variation between individuals within the variety, based primarily on the Mendelian segregation of traits among the progeny of succeeding generations. A variety is considered "true breeding" for a particular trait if it is genetically homozygous for that trait to the extent that, when the true-breeding variety is self-pollinated, a significant amount of independent segregation of the trait among the progeny is not observed. In the present invention, the trait arises from the transgenic expression of one or more DNA sequences introduced into a plant variety.

The crop plants according to the invention will be understood to include dicotyledonous crop plants such as, for example, from the families of the Leguminosae such as pea, alfalfa and soybean; the family of the Umbelliferae, particularly the genus *Daucus* (very particularly the species *carota* (carrot)) and *Apium* (very particularly the species *graveolens* var. dulce (celery)) and many others; the family of the Solanaceae, particularly the genus *Lycopersicon*, very particularly the species *esculentum* (tomato) and the genus *Solanum*, very particularly the species *tuberosum* (potato) and *melongena* (aubergine), tobacco and many others; and the genus *Capsicum*, very particularly the species *annum* (pepper) and many others; the family of the Leguminosae, particularly the genus *Olycine*, very particularly the species max (soybean) and many others; and the family of the Cruciferae, particularly the genus *Brassica*, very particularly the species *napus* (oilseed rape), *campestris* (beet), *oleracea* cv Tastie (cabbage), *oleracea* cv Snowball Y (cauliflower) and *oleracea* cv Emperor (broccoli); and the genus *Arabidopsis*, very particularly the species *thaliana* and many others; the family of the Compositae, particularly the genus *Lactuca*, very particularly the species *sativa* (lettuce) and many others; and the family of the Malvaceae, particularly the genus *Gossypium*, very particularly the species known as cotton; and the family of the Fabaceae, particularly the genus *Arachis*, very particularly the species *hypogaea* (peanut).

The crop plants according to the invention also include monocotyledonous crop plants, such as, for example, cereals such as wheat, barley, *sorghum* and millet, rye, triticale, maize, rice or oats, and sugarcane. Further preferred are trees such as apple, pear, quince, plum, cherry, peach, nectarine, apricot, papaya, mango, and other woody species including coniferous and deciduous trees such as poplar, pine, *sequoia*, cedar, oak, etc. Especially preferred are *Arabidopsis thaliana*, *Nicotiana tabacum*, oilseed rape, soybean, corn (maize), wheat, linseed, potato and tagetes.

The present invention describes for the first time that the SHSRP is useful for increasing a crop plant's root growth, and/or yield, and/or tolerance to environmental stress. As used herein, the term polypeptide refers to a chain of at least four amino acids joined by peptide bonds. The chain may be linear, branched, circular, or combinations thereof. Accordingly, the present invention provides for use in crop plants of isolated SHSRPs selected from any of the organisms as provided in Column No. 2 of Table 1 and Table 2, and homologs thereof. In preferred embodiments, the SHSRP is selected from: 1) any of SHSRP polypeptides as provided in Column No. 4 of Table 1 and Table 2; and 2) homologs and orthologs thereof. Homologs and orthologs of the amino acid sequences are defined below.

The SHSRPs of the present invention are preferably produced by recombinant DNA techniques. For example, a nucleic acid molecule encoding the polypeptide is cloned into an expression vector (as described below), the expression vector is introduced into a host cell (as described below) and the SHSRP is expressed in the host cell. The SHSRP can then be isolated from the cells by an appropriate purification scheme using standard polypeptide purification techniques. For the purposes of the invention, the term "recombinant polynucleotide" refers to a polynucleotide that has been altered, rearranged, or modified by genetic engineering. Examples include any cloned polynucleotide, and polynucleotides that are linked or joined to heterologous sequences. The term "recombinant" does not refer to alterations to polynucleotides that result from naturally occurring events, such as spontaneous mutations. Alternative to recombinant expression, an SHSRP, or peptide thereof, can be synthesized chemically using standard peptide synthesis techniques. Moreover, native SHSRP can be isolated from cells (e.g., *Arabidopsis thaliana* cells), for example using an anti-SHSRP antibody, which can be produced by standard techniques utilizing an SHSRP or fragment thereof.

As used herein, the term "environmental stress" refers to sub-optimal conditions associated with salinity, drought, temperature, metal, chemical, pathogenic and oxidative stresses, or combinations thereof. In preferred embodiments, the environmental stress can be selected from one or more of the group consisting of salinity, drought, or temperature, or combinations thereof, and in particular, can be selected from one or more of the group consisting of high salinity, low water content (drought), or low temperature. In a more preferred embodiment, the environmental stress is drought stress. As also used herein, the term "water use efficiency" refers to the amount of organic matter produced by a plant divided by the amount of water used by the plant in producing it, i.e. the dry weight of a plant in relation to the plant's water use. As used herein, the term "dry weight" refers to everything in the plant other than water, and includes, for example, carbohydrates, proteins, oils, and mineral nutrients. It is also to be understood that as used in the specification and in the claims, "a" or "an" can mean one or more, depending upon the context in which it is used. Thus, for example, reference to "a cell" can mean that at least one cell can be utilized.

As also used herein, the term "nucleic acid" and "polynucleotide" refer to RNA or DNA that is linear or branched, single or double stranded, or a hybrid thereof. The term also encompasses RNA/DNA hybrids. These terms also encompass untranslated sequence located at both the 3' and 5' ends of the coding region of the gene: at least about 1000 nucleotides of sequence upstream from the 5' end of the coding region and at least about 200 nucleotides of sequence downstream from the 3' end of the coding region of the gene. Less common bases, such as inosine, 5-methylcytosine, 6-methyladenine, hypoxanthine, and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made. The antisense polynucleotides and ribozymes can consist entirely of ribonucleotides, or can contain mixed ribonucleotides and deoxyribonucleotides. The polynucleotides of the invention may be produced by any means, including genomic preparations, cDNA preparations, in vitro synthesis, RT-PCR, and in vitro or in vivo transcription.

An "isolated" nucleic acid molecule is one that is substantially separated from other nucleic acid molecules, which are present in the natural source of the nucleic acid (i.e., sequences encoding other polypeptides). Preferably, an "isolated" nucleic acid is free of some of the sequences, which naturally flank the nucleic acid (i.e. sequences located at the 5' and 3' ends of the nucleic acid) in its naturally occurring replicon. For example, a cloned nucleic acid is considered isolated. In various embodiments, the isolated SHSRP nucleic acid molecule can contain less than about 5 kb, 4 kb, 3 kb, 2 kb, 1 kb, 0.5 kb, or 0.1 kb of nucleotide sequences which naturally flank the nucleic acid molecule in genomic DNA of the cell from which the nucleic acid is derived (e.g., an *Arabidopsis thaliana* cell). A nucleic acid is also considered Isolated if it has been altered by human intervention, or placed in a locus or location that is not its natural site, or if it is introduced into a cell by agroinfection. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

Specifically excluded from the definition of "isolated nucleic acids" are: naturally-occurring chromosomes (such as chromosome spreads), artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies. Also specifically excluded are the above libraries wherein a specified nucleic acid makes up less than 5% of the number of nucleic acid inserts in the vector molecules. Further specifically excluded are whole cell genomic DNA or whole cell RNA preparations (including whole cell preparations that are mechanically sheared or enzymatically digested). Even further specifically excluded are the whole cell preparations found as either an in vitro preparation or as a heterogeneous mixture separated by electrophoresis wherein the nucleic acid of the invention has not further been separated from the heterologous nucleic acids in the electrophoresis medium (e.g., further separating by excising a single band from a heterogeneous band population in an agarose gel or nylon blot).

A nucleic acid molecule according to the present invention, e.g., a nucleic acid molecule having a nucleotide sequence as set forth in any of SEQ ID NOS as provided in Column No. 3 of Table 1 and Table 2, or a portion thereof, can be isolated using standard molecular biology techniques and the sequence information provided herein. For example, an SHSRP cDNA can be isolated from any crop library using all or a portion of any of SEQ ID NOS as provided in Column No. 3 of Table 1 and Table 2. Moreover, a nucleic acid molecule encompassing all or a portion of any of SEQ ID NOS as provided in Column No. 3 of Table 1 and Table 2 can be isolated by the polymerase chain reaction using oligonucleotide primers designed based upon this sequence. For example, mRNA can be isolated from plant cells (e.g., by the guanidinium-thiocyanate extraction procedure of Chirgwin et al., 1979, Biochemistry 18:5294-5299), and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon the nucleotide sequence as set forth in any of sequences shown in Column No. 3 of Table 1 and Table 2. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to an SHSRP nucleotide sequence can be prepared by standard synthetic techniques, e.g., using an automated DNA synthesizer.

In a preferred embodiment, an isolated nucleic acid molecule according to the invention comprises the nucleotide sequences as set forth in any of sequences shown in Column No. 3 of Table 1 and Table 2. These cDNAs may comprise sequences encoding the SHSRPs, (i.e., the "coding region"), as well as 5' untranslated sequences and 3' untranslated sequences. Alternatively, the nucleic acid molecules according to the present invention can comprise only the coding region of any of the sequences as provided in Column No. 3 of Table 1 and Table 2, or can contain whole genomic fragments isolated from genomic DNA. The present invention also includes SHSRP coding nucleic acids that encode SHSRPs as described herein. Preferred is an SHSRP coding nucleic acid that encodes SHSRP as shown in any of SEQ ID NOS as provided in Column No. 4 of Table 1 and Table 2.

Moreover, the nucleic acid molecule according to the invention can comprise a portion of the coding region of any of the sequences as provided in Column No. 3 of Table 1 and Table 2, for example, a fragment that can be used as a probe or primer or a fragment encoding a biologically active portion of an SHSRP. The nucleotide sequences determined from the cloning of the SHSRP gene from any of the organisms as provided in Table 1 and Table 2 allows for the generation of probes and primers designed for use in identifying and/or cloning SHSRP homologs in other cell types and organisms, as well as SHSRP homologs from crop plants and related species. The portion of the coding region can also encode a biologically active fragment of an SHSRP.

As used herein, the term "biologically active portion of" an SHSRP is intended to include a portion, e.g., a domain/motif, of an SHSRP that participates in modulation of root growth, and/or yield, and/or stress tolerance in a plant, and more preferably, drought tolerance. For the purposes of the present invention, modulation of root growth, and/or yield, and/or stress tolerance refers to at least a 10% increase or decrease in the growth of the roots, and/or yield, and/or stress tolerance of a transgenic plant comprising an SHSRP expression cassette (or expression vector) as compared to the root growth, and/or yield, and/or stress tolerance of a non-transgenic control plant. Methods for quantitating growth, and/or yield, and/or stress tolerance are provided at least in Examples 5, 6, and 17-19 below. In a preferred embodiment, the biologically active portion of an SHSRP increases a plant's root growth, preferably by increasing the root length.

Biologically active portions of an SHSRP include peptides comprising amino acid sequences derived from the amino acid sequence of an SHSRP, e.g., an amino acid sequence of any of SEQ ID NOS as provided in Column No. 4 of Table 1 and Table 2, or the amino acid sequence of a polypeptide identical to an SHSRP, which includes fewer amino acids than a full length SHSRP or the full length polypeptide which is identical to an SHSRP, and exhibits at least one activity of an SHSRP. Typically, biologically active portions (e.g., peptides which are, for example, 5, 10, 15, 20, 30, 35, 36, 37, 38, 39, 40, 50, 100, or more amino acids in length) comprise a domain or motif with at least one activity of an SHSRP. Moreover, other biologically active portions in which other regions of the polypeptide are deleted, can be prepared by recombinant techniques and evaluated for one or more of the activities described herein. Preferably, the biologically active portion of an SHSRP includes one or more selected domains/motifs or portions thereof having a serine hydroxymethyltransferase activity.

The invention also provides SHSRP chimneric or fusion polypeptides. As used herein, an SHSRP "chimeric polypeptide" or "fusion polypeptide" comprises an SHSRP operatively linked to a non-SHSRP. An SHSRP refers to a polypeptide having an amino acid sequence corresponding to an SHSRP, whereas a non-SHSRP refers to a polypeptide having an amino acid sequence corresponding to a polypeptide which is not substantially identical to the SHSRP, e.g., a polypeptide that is different from the SHSRP and is derived from the same or a different organism. With respect to the fusion polypeptide, the term "operatively linked" is intended to indicate that the SHSRP and the non-SHSRP are fused to each other so that both sequences fulfill the proposed function attributed to the sequence used. The non-SHSRP can be fused to the N-terminus or C-terminus of the SHSRP. For example, in one embodiment, the fusion polypeptide is a GST-SHSRP fusion polypeptide in which the SHSRP sequences are fused to the C-terminus of the OST sequences. Such fusion polypeptides can facilitate the purification of recombinant SHSRPs. In another embodiment, the fusion polypeptide is an SHSRP containing a heterologous signal sequence at its N-terminus. In certain host cells (e.g., mammalian host cells), expression and/or secretion of an SHSRP can be increased through use of a heterologous signal sequence.

Preferably, an SHSRP chimeric or fusion polypeptide of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and re-amplified to generate a chimeric gene sequence (See, for example, Current Protocols in Molecular Biology, Eds. Ausubel et al. John Wiley & Sons: 1992). Moreover, many expression vectors are commercially available that already encode a fusion moiety (e.g., a GST polypeptide). An SHSRP encoding nucleic acid can be cloned into such an expression vector such that the fusion moiety is linked in-frame to the SHSRP.

In addition to fragments and fusion polypeptides of the SHSRPs described herein, the present invention includes homologs and analogs of naturally occurring SHSRPs and SHSRP encoding nucleic acids in a plant. "Homologs" are defined herein as two nucleic acids or polypeptides that have similar, or "identical," nucleotide or amino acid sequences, respectively. Homologs include allelic variants, orthologs, paralogs, agonists, and antagonists of SHSRPs as defined hereafter. The term "homolog" further encompasses nucleic acid molecules that differ from the nucleotide sequence as set forth in any of SEQ ID NOS as provided in Column No. 3 of Table 1 and Table 2 (and portions thereof) due to degeneracy of the genetic code and thus encode the same SHSRP as that encoded by the corresponding nucleotide sequence as set forth in such a SEQ ID NO as provided in Column No. 3 of Table 1 and Table 2. As used herein, a "naturally occurring" SHSRP refers to an SHSRP amino acid sequence that occurs in nature. Preferably, a naturally occurring SHSRP comprises an amino acid sequence of any of SEQ ID NOS as provided in Column No. 4 of Table 1 and Table 2.

An agonist of the SHSRP can retain substantially the same, or a subset, of the biological activities of the SHSRP. An antagonist of the SHSRP can inhibit one or more of the activities of the naturally occurring form of the SHSRP.

Nucleic acid molecules corresponding to natural allelic variants and analogs, orthologs, and paralogs of an SHSRP cDNA can be isolated based on their identity to the SHSRP nucleic acids described herein using SHSRP cDNAs, or a portion thereof, as a hybridization probe according to standard hybridization techniques under stringent hybridization conditions. In an alternative embodiment, homologs of the SHSRP can be identified by screening combinatorial libraries of mutants, e.g., truncation mutants, of the SHSRP for SHSRP agonist or antagonist activity. In one embodiment, a variegated library of SHSRP variants is generated by combinatorial mutagenesis at the nucleic acid level and is encoded by a variegated gene library. A variegated library of SHSRP variants can be produced by, for example, enzymatically ligating a mixture of synthetic oligonucleotides into gene sequences such that a degenerate set of potential SHSRP sequences is expressible as individual polypeptides, or alternatively, as a set of larger fusion polypeptides (e.g., for phage display) containing the set of SHSRP sequences therein. There are a variety of methods that can be used to produce libraries of potential SHSRP homologs from a degenerate oligonucleotide sequence. Chemical synthesis of a degenerate gene sequence can be performed in an automatic DNA synthesizer, and the synthetic gene is then ligated into an appropriate expression vector. Use of a degenerate set of genes allows for the provision, in one mixture, of all of the sequences encoding the desired set of potential SHSRP sequences. Methods for synthesizing degenerate oligonucleotides are known in the art.

In addition, libraries of fragments of the SHSRP coding regions can be used to generate a variegated population of SHSRP fragments for screening and subsequent selection of homologs of an SHSRP. In one embodiment, a library of coding sequence fragments can be generated by treating a double stranded PCR fragment of an SHSRP coding sequence with a nuclease under conditions wherein nicking occurs only about once per molecule, denaturing the double stranded DNA, renaturing the DNA to form double stranded DNA, which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal, and internal fragments of various sizes of the SHSRP.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of SHSRP homologs. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify SHSRP homologs (Arkin and Yourvan, 1992, PNAS 89:7811-7815; Delgrave et al., 1993, Polypeptide Engineering 6(3):327-331). In another embodiment, cell based assays can be exploited to analyze a variegated SHSRP library, using methods well known in the art. The present invention further provides a method of identifying a novel SHSRP, comprising (a) raising a specific antibody response to an SHSRP, or a fragment thereof, as described herein; (b) screening putative SHSRP material with the antibody, wherein specific binding of the antibody to the material indicates the presence of a potentially novel SHSRP; and (c) analyzing the bound material in comparison to known SHSRP, to determine its novelty.

As stated above, the present invention relates to SHSRPs and homologs thereof. To determine the percent sequence identity of two amino acid sequences (e.g., the sequence of any of SEQ ID NOS as provided in Column No. 4 of Table 1 and Table 2, and a mutant form thereof), the sequences are aligned for optimal comparison purposes (e.g., gaps can be introduced in the sequence of one polypeptide for optimal alignment with the other polypeptide or nucleic acid). The amino acid residues at corresponding amino acid positions are then compared. When a position in one sequence (e.g., the sequence of any of SEQ ID NOS as provided in Column No. 4 of Table 1 and Table 2) is occupied by the same amino acid residue as the corresponding position in the other sequence (e.g., the sequence of a mutant form of the corresponding SEQ ID NO as provided in Column No. 4 of Table 1 and Table 2), then the molecules are identical at that position. The same type of comparison can be made between two nucleic acid sequences.

The percent sequence identity between the two sequences is a function of the number of identical positions shared by the sequences (i.e., percent sequence identity=numbers of identical positions/total numbers of positions ×100). Preferably, the isolated amino acid homologs included in the present invention are at least about 50-60%, preferably at least about 60-70%, and more preferably at least about 70-75%, 75-80%, 80-85%, 85-90%, or 90-95%, and most preferably at least about 96%, 97%, 98%, 99%, or more identical to an entire amino acid sequence shown in any of SEQ ID NOS as provided in Column No. 4 of Table 1 and Table 2. In yet another embodiment, the isolated amino acid homologs included in the present invention are at least about 50-60%, preferably at least about 60-70%, and more preferably at least about 70-75%, 75-80%, 80-85%, 85-90%, or 90-95%, and most preferably at least about 96%, 97%, 98%, 99%, or more identical to an entire amino acid sequence encoded by a nucleic acid sequence shown in any of SEQ ID NOS as provided in Column No. 3 of Table 1 and Table 2.

In one embodiment, the isolated amino acid homolog comprises at least one of the following two conserved motifs. The first motif is $X_1$TNKYSEG (SEQ ID NO:157), wherein $X_1$ is either a leucine or a methionine amino acid residue. The second motif is DRIM$X_2$L$X_3X_4$PS (SEQ ID NO: 158), wherein $X_2$ is either a glycine or alanine amino acid residue, $X_3$ is either an aspartic acid or glutamic acid residue, and $X_4$ is a threonine, a proline, or a leucine amino acid residue.

In another preferred embodiment, an isolated nucleic acid homolog of the invention comprises a nucleotide sequence which is at least about 40-60%, preferably at least about 60-70%, more preferably at least about 70-75%, 75-80%, 80-85%, 85-90%, or 90-95%, and even more preferably at least about 95%, 96%, 97%, 98%, 99%, or more identical to a nucleotide sequence shown in any of SEQ ID NOS as provided in Column No. 3 of Table 1 and Table 2, or to a portion comprising at least 60 consecutive nucleotides thereof. The preferable length of sequence comparison for nucleic acids is at least 75 nucleotides, more preferably at least 100 nucleotides, and most preferably the entire length of the coding region. It is even more preferable that the nucleic acid homologs encode proteins having homology with any of SEQ ID NOS as provided in Column No. 4 of Table 1 and Table 2.

It is further preferred that the isolated nucleic acid homolog of the invention encodes an SHSRP, or portion thereof, that is at least 80% identical to an amino acid sequence of any of SEQ ID NOS as provided in Column No. 4 of Table 1 and Table 2, and that functions as a modulator of root growth, and/or yield, and/or an environmental stress response in a plant. In a more preferred embodiment, overexpression of the nucleic acid homolog in a plant increases the plant's root growth, and/or yield, and/or the tolerance of the plant to an environmental stress. In a further preferred embodiment, the nucleic acid homolog encodes an SHSRP that functions as a serine hydroxymethyltransferase.

For the purposes of the invention, the percent sequence identity between two nucleic acid or polypeptide sequences is determined using the Needleman-Wunsch global alignment algorithm (J. Mol. Biol. 48(3):443-53) implemented in the European Molecular Biology Open Software Suite (EMBOSS). For purposes of a multiple alignment (Clustal W algorithm), the gap opening penalty is 10, and the gap extension penalty is 0.05 with blosum62 matrix. It is to be understood that for the purposes of determining sequence identity when comparing a DNA sequence to an RNA sequence, a thymidine nucleotide is equivalent to a uracil nucleotide.

In another aspect, the invention relates to an isolated nucleic acid comprising a polynucleotide that hybridizes to the polynucleotide of any of SEQ ID NOS as provided in Column No. 3 of Table 1 and Table 2 under stringent conditions. More particularly, an isolated nucleic acid molecule according to the invention is at least 15 nucleotides in length and hybridizes under stringent conditions to the nucleic acid molecule comprising a nucleotide sequence of any of SEQ ID NOS as provided in Column No. 3 of Table 1 and Table 2. In other embodiments, the nucleic acid is at least 30, 50, 100, 250, or more nucleotides in length. Preferably, an isolated nucleic acid homolog of the invention comprises a nucleotide sequence which hybridizes under highly stringent conditions to the nucleotide sequence shown in any of SEQ ID NOS as provided in Column No. 3 of Table 1 and Table 2 and functions as a modulator of root growth, and/or yield, and/or stress tolerance in a plant. In a further preferred embodiment, overexpression of the isolated nucleic acid homolog in a plant increases a plant's root growth, and/or yield, and/or tolerance to an environmental stress. In an even further preferred embodiment, the isolated nucleic acid homolog encodes an SHSRP that functions as a serine hydroxymethyltransferase.

As used herein with regard to hybridization for DNA to a DNA blot, the term "stringent conditions" may refer to hybridization overnight at 60° C. in 10× Denhart's solution, 6×SSC, 0.5% SDS, and 100 µg/ml denatured salmon sperm DNA. Blots are washed sequentially at 62° C. for 30 minutes each time in 3×SSC/0.1% SDS, followed by 1×SSC/0.1% SDS, and finally 0.1×SSC/0.1% SDS. In a preferred embodiment, the phrase "stringent conditions" refers to hybridization in a 6×SSC solution at 65° C. As also used herein, "highly stringent conditions" refers to hybridization overnight at 65° C. in 10× Denharts solution, 6×SSC, 0.5% SDS, and 100 µg/ml denatured salmon sperm DNA. Blots are washed sequentially at 65° C. for 30 minutes each time in 3×SSC/0.1% SDS, followed by 1×SSC/0.1% SDS, and finally 0.1×SSC/0.1% SDS. Methods for nucleic acid hybridizations are described in Meinkoth and Wahl, 1984, Anal. Biochem. 138: 267-284; Current Protocols in Molecular Biology, Chapter 2, Ausubel et al. Eds., Greene Publishing and Wiley-Interscience, New York, 1995; and Tijssen, 1993, Laboratory Techniques in Biochemistry and Molecular Biology Hybridization with Nucleic Acid Probes, Part I, Chapter 2, Elsevier, New York, 1993. Preferably, an isolated nucleic acid molecule of the invention that hybridizes under stringent or highly stringent conditions to a sequence of any of SEQ ID NOS as provided in Column No. 3 of Table 1 and Table 2 corresponds to a naturally occurring nucleic acid molecule. As used herein, a "naturally occurring" nucleic acid molecule refers to an RNA or DNA molecule having a nucleotide sequence that occurs in nature (e.g., encodes a natural polypeptide). In one embodiment, the nucleic acid encodes a naturally occurring SHSRP.

Using the above-described methods, and others known to those of skill in the art, one of ordinary skill in the art can isolate homologs of the SHSRPs comprising amino acid sequences shown in any of SEQ ID NOS as provided in Column No. 4 of Table 1 and Table 2. One subset of these homologs is allelic variants. As used herein, the term "allelic variant" refers to a nucleotide sequence containing polymorphisms that lead to changes in the amino acid sequences of an SHSRP and that exist within a natural population (e.g., a plant species or variety). Such natural allelic variations can typically result in 1-5% variance in an SHSRP nucleic acid. Allelic variants can be identified by sequencing the nucleic acid sequence of interest in a number of different plants, which can be readily carried out by using hybridization probes to identify the same SHSRP genetic locus in those plants. Any and all such nucleic acid variations and resulting amino acid polymorphisms or variations in an SHSRP that are the result of natural allelic variation and that do not alter the functional activity of an SHSRP, are intended to be within the scope of the invention.

Moreover, nucleic acid molecules encoding SHSRPs from the same or other species such as SHSRP analogs, orthologs, and paralogs, are intended to be within the scope of the present invention. As used herein, the term "analogs" refers to two nucleic acids that have the same or similar function, but that have evolved separately in unrelated organisms. As used herein, the term "orthologs" refers to two nucleic acids from different species, but that have evolved from a common ancestral gene by speciation. Normally, orthologs encode polypeptides having the same or similar functions. As also used herein, the term "paralogs" refers to two nucleic acids that are related by duplication within a genome. Paralogs usually have different functions, but these functions may be related (Tatusov, R. L. et al., 1997, Science 278(5338):631-637). Analogs, orthologs, and paralogs of a naturally occurring SHSRP can differ from the naturally occurring SHSRP by post-translational modifications, by amino acid sequence differences, or by both. Post-translational modifications include in vivo and in vitro chemical derivatization of polypeptides, e.g., acetylation, carboxylation, phosphorylation, or glycosylation, and such modifications may occur during polypeptide synthesis or processing or following treatment with isolated modifying enzymes. In particular, orthologs of the invention will generally exhibit at least 80-85%, more preferably, 85-90% or 90-95%, and most preferably 95%, 96%, 97%, 98%, or even 99% identity, or 100% sequence identity, with all or part of a naturally occurring SHSRP amino acid sequence, and will exhibit a function similar to an SHSRP. Preferably, an SHSRP ortholog of the present invention functions as a modulator of growth and/or an environmental stress response in a plant and/or functions as a vesicle trafficking protein. More preferably, an SHSRP ortholog increases the growth and/or stress tolerance of a plant. In one embodiment, the SHSRP orthologs function as a serine hydroxymethyltransferase.

In addition to naturally-occurring variants of an SHSRP sequence that may exist in the population, the skilled artisan will further appreciate that changes can be introduced by mutation into a nucleotide sequence of any of SEQ ID NOS as provided in Column No. 4 of Table 1 and Table 2, thereby leading to changes in the amino acid sequence of the encoded SHSRP, without altering the functional activity of the SHSRP. For example, nucleotide substitutions leading to amino acid substitutions at "non-essential" amino acid residues can be made in a sequence of any of SEQ ID NOS as provided in Column No. 3 of Table 1 and Table 2. A "non-essential" amino acid residue is a residue that can be altered from the wild-type sequence of one of the SHSRPs without altering the activity of said SHSRP, whereas an "essential" amino acid residue is required for SHSRP activity. Other amino acid residues, however, (e.g., those that are not conserved or only semi-conserved in the domain having SHSRP activity) may not be essential for activity and thus are likely to be amenable to alteration without altering SHSRP activity.

Accordingly, another aspect of the invention pertains to nucleic acid molecules encoding SHSRPs that contain changes in amino acid residues that are not essential for SHSRP activity. Such SHSRPs differ in amino acid sequence from a sequence contained in any of SEQ ID NOS as provided in Column No. 4 of Table 1 and Table 2, yet retain at least one of the SHSRP activities described herein. In one embodiment, the isolated nucleic acid molecule comprises a nucleotide sequence encoding a polypeptide, wherein the polypeptide comprises an amino acid sequence at least about 50-60% identical to the sequence of any of SEQ ID NOS as provided in Column No. 4 of Table 1 and Table 2, more preferably at least about 60-70% identical to the sequence of any of SEQ ID NOS as provided in Column No. 4 of Table 1 and Table 2, even more preferably at least about 70-75%, 75-80%, 80-85%, 85-90%, or 90-95% identical to the sequence of any of SEQ ID NOS as provided in Column No. 4 of Table 1 and Table 2, and most preferably at least about 96%, 97%, 98%, or 99% Identical to the sequence of any of SEQ ID NOS as provided in Column No. 4 of Table 1 and Table 2. The preferred SHSRP homologs of the present invention preferably participate in a plant's root growth, and/or yield, and/or a stress tolerance response in a plant, or more particularly, function as a serine hydroxymethyltransferase.

An isolated nucleic acid molecule encoding an SHSRP having sequence identity with a polypeptide sequence of any of SEQ ID NOS as provided in Column No. 4 of Table 1 and Table 2 can be created by introducing one or more nucleotide substitutions, additions, or deletions into a nucleotide sequence of any of SEQ ID NOS as provided in Column No. 3 of Table 1 and Table 2, such that one or more amino acid substitutions, additions, or deletions are introduced into the encoded polypeptide. Mutations can be introduced into the sequence of any of SEQ ID NOS as provided in Column No. 3 of Table 1 and Table 2 by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine). Thus, a predicted nonessential amino acid residue in an SHSRP is preferably replaced with another amino acid residue from the same side chain family. Alternatively, in another embodiment, mutations can be introduced randomly along all or part of an SHSRP coding sequence, such as by saturation mutagenesis, and the resultant mutants can be screened for an SHSRP activity described herein to identify mutants that retain SHSRP activity. Following mutagenesis of the sequence of any of SEQ ID NOS as provided in Column No. 3 of Table 1 and Table 2 the encoded polypeptide can be expressed recombinantly and the activity of the polypeptide can be determined by analyzing the root growth, and/or yield, and/or stress tolerance of a plant expressing the polypeptide as described at least in Examples 5, 6, and 17-19.

Additionally, optimized SHSRP nucleic acids can be created. Preferably, an optimized SHSRP nucleic acid encodes an SHSRP that modulates a plant's root growth, and/or yield, and/or tolerance to an environmental stress, and more preferably increases a plant's root growth, and/or yield, and/or tolerance to an environmental stress upon its overexpression in the plant. As used herein, "optimized" refers to a nucleic acid that is genetically engineered to increase its expression in a given plant or animal. To provide plant optimized SHSRP nucleic acids, the DNA sequence of the gene can be modified to 1) comprise codons preferred by highly expressed plant genes; 2) comprise an A+T content in nucleotide base composition to that substantially found in plants; 3) form a plant initiation sequence; or 4) to eliminate sequences that cause destabilization, inappropriate polyadenylation, degradation and termination of RNA, or that form secondary structure hairpins or RNA splice sites. Increased expression of SHSRP nucleic acids in plants can be achieved by utilizing the distribution frequency of codon usage in plants in general or in a particular plant. Methods for optimizing nucleic acid expression in plants can be found in EPA 0359472; EPA 0385962; PCT Application No. WO 91/16432; U.S. Pat. No. 5,380,831; U.S. Pat. No. 5,436,391; Perlack et al., 1991, Proc. Natl.

Acad. Sci. USA 88:3324-3328; and Murray et al., 1989, Nucleic Acids Res. 17:477-498.

As used herein, "frequency of preferred codon usage" refers to the preference exhibited by a specific host cell in usage of nucleotide codons to specify a given amino acid. To determine the frequency of usage of a particular codon in a gene, the number of occurrences of that codon in the gene is divided by the total number of occurrences of all codons specifying the same amino acid in the gene. Similarly, the frequency of preferred codon usage exhibited by a host cell can be calculated by averaging frequency of preferred codon usage in a large number of genes expressed by the host cell. It is preferable that this analysis be limited to genes that are highly expressed by the host cell. The percent deviation of the frequency of preferred codon usage for a synthetic gene from that employed by a host cell is calculated first by determining the percent deviation of the frequency of usage of a single codon from that of the host cell followed by obtaining the average deviation over all codons. As defined herein, this calculation includes unique codons (i.e., ATG and TGG). In general terms, the overall average deviation of the codon usage of an optimized gene from that of a host cell is calculated using the equation $1A=n=1ZX_n-Y_nX_n$ times 100 Z where $X_n$=frequency of usage for codon n in the host cell; $Y_n$=frequency of usage for codon n in the synthetic gene; n represents an individual codon that specifies an amino acid; and the total number of codons is Z. The overall deviation of the frequency of codon usage, A, for all amino acids should preferably be less than about 25%, and more preferably less than about 10%.

Hence, an SHSRP nucleic acid can be optimized such that its distribution frequency of codon usage deviates, preferably, no more than 25% from that of highly expressed plant genes and, more preferably, no more than about 10%. In addition, consideration is given to the percentage G+C content of the degenerate third base (monocotyledons appear to favor G+C in this position, whereas dicotyledons do not). It is also recognized that the XCG (where X is A, T, C, or G) nucleotide is the least preferred codon in dicots whereas the XTA codon is avoided in both monocots and dicots. Optimized SHSRP nucleic acids of this invention also preferably have CG and TA doublet avoidance indices closely approximating those of the chosen host plant (e.g., *Arabidopsis thaliana, Oryza sativa* etc.). More preferably these indices deviate from that of the host by no more than about 10-15%.

In addition to the nucleic acid molecules encoding the SHSRPs described above, another aspect of the invention pertains to Isolated nucleic acid molecules that are antisense thereto. Antisense polynucleotides are thought to inhibit gene expression of a target polynucleotide by specifically binding the target polynucleotide and interfering with transcription, splicing, transport, translation, and/or stability of the target polynucleotide. Methods are described in the prior art for targeting the antisense polynucleotide to the chromosomal DNA, to a primary RNA transcript, or to a processed mRNA. Preferably, the target regions include splice sites, translation initiation codons, translation termination codons, and other sequences within the open reading frame.

The term "antisense," for the purposes of the invention, refers to a nucleic acid comprising a polynucleotide that is sufficiently complementary to all or a portion of a gene, primary transcript, or processed mRNA, so as to interfere with expression of the endogenous gene. "Complementary" polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. It is understood that two polynucleotides may hybridize to each other even if they are not completely complementary to each other, provided that each has at least one region that is substantially complementary to the other. The term "antisense nucleic acid" includes single stranded RNA as well as double-stranded DNA expression cassettes that can be transcribed to produce an antisense RNA. "Active" antisense nucleic acids are antisense RNA molecules that are capable of selectively hybridizing with a primary transcript or mRNA encoding a polypeptide having at least 80% sequence identity with the polypeptide of any of SEQ ID NOS as provided in Column No. 4 of Table 1 and Table 2.

The antisense nucleic acid can be complementary to an entire SHSRP coding strand, or to only a portion thereof. In one embodiment, an antisense nucleic acid molecule is antisense to a "coding region" of the coding strand of a nucleotide sequence encoding an SHSRP. The term "coding region" refers to the region of the nucleotide sequence comprising codons that are translated into amino acid residues. In another embodiment, the antisense nucleic acid molecule is antisense to a "noncoding region" of the coding strand of a nucleotide sequence encoding an SHSRP. The term "noncoding region" refers to 5' and 3' sequences that flank the coding region that are not translated into amino acids (i.e., also referred to as 5' and 3' untranslated regions). The antisense nucleic acid molecule can be complementary to the entire coding region of SHSRP mRNA, but more preferably is an oligonucleotide that is antisense to only a portion of the coding or noncoding region of SHSRP mRNA. For example, the antisense oligonucleotide can be complementary to the region surrounding the translation start site of SHSRP mRNA. An antisense oligonucleotide can be, for example, about 5, 10, 15, 20, 25, 30, 35, 40, 45, or 50 nucleotides in length. Typically, the antisense molecules of the present invention comprise an RNA having 60-100% sequence identity with at least 14 consecutive nucleotides of any of SEQ ID NOS as provided in Column No. 3 of Table 1 and Table 2 or a polynucleotide encoding a polypeptide of any of SEQ ID NOS as provided in Column No. 4 of Table 1 and Table 2. Preferably, the sequence identity will be at least 70%, more preferably at least 75%, 80%, 85% 90%, 95%, or 98%, and most preferably 99%.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al., 1987, Nucleic Acids. Res. 15:6625-6641). The antisense nucleic acid molecule can also comprise a 2'-O-methylribonucleotide (Inoue et al., 1987, Nucleic Acids Res. 15:6131-6148) or a chimeric RNA-DNA analogue (Inoue et al., 1987, FEBS Lett. 215:327-330).

The antisense nucleic acid molecules of the invention are typically administered to a cell or generated in situ such that they hybridize with or bind to cellular mRNA and/or genomic DNA encoding an SHSRP to thereby inhibit expression of the polypeptide, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

As an alternative to antisense polynucleotides, ribozymes, sense polynucleotides, or double stranded RNA (dsRNA) can be used to reduce expression of an SHSRP polypeptide. As used herein, the term "ribozyme" refers to a catalytic RNA-based enzyme with ribonuclease activity that is capable of cleaving a single-stranded nucleic acid, such as an mRNA, to which it has a complementary region. Ribozymes (e.g., hammerhead ribozymes described in Haselhoff and Gerlach, 1988, Nature 334:585-591) can be used to catalytically cleave SHSRP mRNA transcripts to thereby inhibit translation of SHSRP mRNA. A ribozyme having specificity for an SHSRP-encoding nucleic acid can be designed based upon the nucleotide sequence of an SHSRP cDNA, as disclosed herein (i.e., any of SEQ ID NOS as provided in Column No. 3 of Table 1 and Table 2) or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an SHSRP-encoding mRNA. See, e.g., U.S. Pat. Nos. 4,987,071 and 5,116,742 to Cech et al. Alternatively, SHSRP mRNA can be used to select a catalytic RNA having a specific ribonuclease activity from a pool of RNA molecules. See, e.g., Bartel, D. and Szostak, J. W., 1993, Science 261:1411-1418. In preferred embodiments, the ribozyme will contain a portion having at least 7, 8, 9, 10, 12, 14, 16, 18, or 20 nucleotides, and more preferably 7 or 8 nucleotides, that have 100% complementarity to a portion of the target RNA. Methods for making ribozymes are known to those skilled in the art. See, e.g., U.S. Pat. Nos. 6,025,167; 5,773,260; and 5,496,698.

The term "dsRNA," as used herein, refers to RNA hybrids comprising two strands of RNA. The dsRNAs can be linear or circular in structure. In a preferred embodiment, dsRNA is specific for a polynucleotide encoding either the polypeptide of any of SEQ ID NOS as provided in Column No. 4 of Table 1 and Table 2 or a polypeptide having at least 80% sequence identity with a polypeptide of any of SEQ ID NOS as provided in Column No. 4 of Table 1 and Table 2. The hybridizing RNAs may be substantially or completely complementary. By "substantially complementary," is meant that when the two hybridizing RNAs are optimally aligned using the BLAST program as described above, the hybridizing portions are at least 95% complementary. Preferably, the dsRNA will be at least 100 base pairs in length. Typically, the hybridizing RNAs will be of identical length with no over hanging 5' or 3' ends and no gaps. However, dsRNAs having 5' or 3' overhangs of up to 100 nucleotides may be used in the methods of the invention.

The dsRNA may comprise ribonucleotides, ribonucleotide analogs such as 2'-O-methyl ribosyl residues, or combinations thereof. See, e.g., U.S. Pat. Nos. 4,130,641 and 4,024,222. A dsRNA polyriboinosinic acid:polyribocytidylic acid is described in U.S. Pat. No. 4,283,393. Methods for making and using dsRNA are known in the art. One method comprises the simultaneous transcription of two complementary DNA strands, either in vivo, or in a single in vitro reaction mixture. See, e.g., U.S. Pat. No. 5,795,715. In one embodiment, dsRNA can be introduced into a plant or plant cell directly by standard transformation procedures. Alternatively, dsRNA can be expressed in a plant cell by transcribing two complementary RNAs.

Other methods for the inhibition of endogenous gene expression, such as triple helix formation (Moser et al., 1987, Science 238:645-650 and Cooney et al., 1988, Science 241: 456-459) and co-suppression (Napoli et al., 1990, The Plant Cell 2:279-289) are known in the art. Partial and full-length cDNAs have been used for the cosuppression of endogenous plant genes. See, e.g., U.S. Pat. Nos. 4,801,340, 5,034,323, 5,231,020, and 5,283,184; Van der Kroll et al., 1990, The Plant Cell 2:291-299; Smith et al., 1990, Mol. Gen. Genetics 224:477-481; and Napoli et al., 1990, The Plant Cell 2:279-289.

For sense suppression, it is believed that introduction of a sense polynucleotide blocks transcription of the corresponding target gene. The sense polynucleotide will have at least 65% sequence identity with the target plant gene or RNA. Preferably, the percent identity is at least 80%, 90%, 95%, or more. The introduced sense polynucleotide need not be full length relative to the target gene or transcript. Preferably, the sense polynucleotide will have at least 65% sequence identity with at least 100 consecutive nucleotides of any of SEQ ID NOS as provided in Column No. 3 of Table 1 and Table 2. The regions of identity can comprise introns and/or exons and untranslated regions. The introduced sense polynucleotide may be present in the plant cell transiently, or may be stably integrated into a plant chromosome or extrachromosomal replicon.

Alternatively, SHSRP gene expression can be inhibited by targeting nucleotide sequences complementary to the regulatory region of an SHSRP nucleotide sequence (e.g., an SHSRP promoter and/or enhancer) to form triple helical structures that prevent transcription of an SHSRP gene in target cells. See generally, Helene, C., 1991, Anticancer Drug Des. 6(6):569-84; Helene, C. et al., 1992, Ann. N. Y. Acad. Sci. 660:27-36; and Maher, L. J., 1992, Bioassays 14(12): 807-15.

In addition to the SHSRP nucleic acids and polypeptides described above, the present invention encompasses these nucleic acids and polypeptides attached to a moiety. These moieties include, but are not limited to, detection moieties, hybridization moieties, purification moieties, delivery moieties, reaction moieties, binding moieties, and the like. A typical group of nucleic acids having moieties attached are probes and primers. Probes and primers typically comprise a substantially isolated oligonucleotide. The oligonucleotide typically comprises a region of nucleotide sequence that hybridizes under stringent conditions to at least about 12, preferably about 25, more preferably about 40, 50, or 75 consecutive nucleotides of a sense strand of the sequence set forth in any of SEQ ID NOS as provided in Column No. 3 of Table 1 and Table 2; an anti-sense sequence of the sequence set forth in any of SEQ ID NOS as provided in Column No. 3 of Table 1 and Table 2; or naturally occurring mutants thereof. Primers based on a nucleotide sequence of any of SEQ ID NOS as provided in Column No. 3 of Table 1 and Table 2 can be used in PCR reactions to clone SHSRP homologs. Probes based on the SHSRP nucleotide sequences can be used to detect transcripts or genomic sequences encoding the same or substantially identical polypeptides. In preferred embodiments, the probe further comprises a label group attached thereto, e.g. the label group can be a radioisotope, a fluorescent compound, an enzyme, or an enzyme co-factor. Such probes can be used as a part of a genomic marker test kit for identifying cells which express an SHSRP, such as by measuring a level of an SHSRP-encoding nucleic acid, in a sample of cells, e.g., detecting SHSRP mRNA levels or determining whether a genomic SHSRP gene has been mutated or deleted.

In particular, a useful method to ascertain the level of transcription of the gene (an indicator of the amount of mRNA available for translation to the gene product) is to perform a Northern blot (For reference, see, for example, Ausubel et al., 1988, Current Protocols in Molecular Biology, Wiley: New York). The information from a Northern blot at least partially demonstrates the degree of transcription of the transformed gene. Total cellular RNA can be prepared from cells, tissues, or organs by several methods, all well-known in the art, such as that described in Bormann, E. R. et al., 1992, Mol. Microbiol. 6:317-326. To assess the presence or relative quantity of polypeptide translated from this mRNA, standard techniques, such as a Western blot, may be employed. These techniques are well known to one of ordinary skill in the art. (See, for example, Ausubel et al., 1988, Current Protocols in Molecular Biology, Wiley: New York).

The invention further provides an isolated recombinant expression vector comprising an SHSRP nucleic acid, wherein expression of the vector in a host cell results in increased root growth, and/or yield, and/or tolerance to environmental stress as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. As used herein with respect to a recombinant expression vector, "operatively linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers, and other expression control elements (e.g., polyadenylation signals). Such regulatory sequences are described, for example, in Goeddel, Gene Expression Technology Methods in Enzymology 185, Academic Press, San Diego, Calif. (1990) and Gruber and Crosby, in: Methods in Plant Molecular Biology and Biotechnology, eds. Glick and Thompson, Chapter 7, 89-108, CRC Press: Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., SHSRPs, mutant forms of SHSRPs, fusion polypeptides, etc.).

The recombinant expression vectors of the invention can be designed for expression of SHSRPs in prokaryotic or eukaryotic cells. For example, SHSRP genes can be expressed in bacterial cells such as *C. glutamicum*, insect cells (using baculovirus expression vectors), yeast and other fungal cells (See Romanos, M. A. et al., 1992, Foreign gene expression in yeast: a review, Yeast 8:423-488; van den Hondel, C. A. M. J. J. et al., 1991, Heterologous gene expression in filamentous fungi, in: More Gene Manipulations in Fungi, J. W. Bennet & L. L. Lasure, eds., p. 396-428: Academic Press: San Diego; and van den Hondel, C. A. M. J. J. & Punt, P. J., 1991, Gene transfer systems and vector development for filamentous fungi, in: Applied Molecular Genetics of Fungi, Peberdy, J. F. et al., eds., p. 1-28, Cambridge University Press: Cambridge), algae (Falciatore et al., 1999, Marine Biotechnology 1(3): 239-251), ciliates of the types: *Holotrichia, Peritrichia, Spirotrichia, Suctorla, Tetrahymena, Paramecium, Colpidium, Glaucoma, Platyophrya, Potomacus, Pseudocohnilembus, Euplotes, Engelmanlella*, and *Stylonychia*, especially of the genus *Stylonychia lemnae* with vectors following a transformation method as described in PCT Application No. WO 98/01572, and multicellular plant cells (See Schmidt, R. and Willmitzer, L., 1988, High efficiency *Agrobacterumn tumefaclens*-mediated transformation of *Arabidopsis thaliana* leaf and cotyledon explants, Plant Cell Rep. 583-586; Plant Molecular Biology and Biotechnology, C Press, Boca Raton, Fla., chapter 6/7, S.71-119 (1993); F. F. White, B. Jenes et al., Techniques for Gene Transfer, in: Transgenic Plants, Vol. 1, Engineering and Utilization, eds. Kung und R. Wu, 128-43, Academic Press: 1993; Potrykus, 1991, Annu. Rev. Plant Physiol. Plant Molec. Biol. 42:205-225 and references cited therein), or mammalian cells. Suitable host cells are discussed further in Goeddel, Gene Expression Technology Methods in Enzymology 185, Academic Press: San Diego, Calif. (1990). Alternatively, the recombinant expression vector can be transcribed and translated in vitro, for example using T7 promoter regulatory sequences and T7 polymerase.

Expression of polypeptides in prokaryotes is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide but also to the C-terminus or fused within suitable regions in the polypeptides. Such fusion vectors typically serve three purposes: 1) to increase expression of a recombinant polypeptide; 2) to increase the solubility of a recombinant polypeptide; and 3) to aid in the purification of a recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin, and enterokinase.

Typical fusion expression vectors include pGEX (Pharmacia Biotech Inc; Smith, D. B. and Johnson, K. S., 1988, Gene 67:31-40), pMAL (New England Biolabs, Beverly, Mass.), and pRITS (Pharmacia, Piscataway, N.J.) which fuse glutathione S-transferase (GST), maltose E binding polypeptide, or polypeptide A, respectively, to the target recombinant polypeptide. In one embodiment, the coding sequence of the SHSRP is cloned into a pGEX expression vector to create a vector encoding a fusion polypeptide comprising, from the N-terminus to the C-terminus, GST-thrombin cleavage site-X polypeptide. The fusion polypeptide can be purified by affinity chromatography using glutathione-agarose resin. Recombinant SHSRP unfused to OST can be recovered by cleavage of the fusion polypeptide with thrombin.

Examples of suitable inducible non-fusion *E. coli* expression vectors include pTrc (Amann et al., 1988, Gene 69:301-315) and pET 11d (Studier et al., Gene Expression Technology: Methods in Enzymology 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174(DE3) from a resident prophage harboring a T7 gn1 gene under the transcriptional control of the lacUV 5 promoter.

One strategy to maximize recombinant polypeptide expression is to express the polypeptide in a host bacterium with an impaired capacity to proteolytically cleave the recombinant polypeptide (Gottesman, S., Gene Expression Technology: Methods in Enzymology 185, Academic Press, San Diego, Calif. (1990) 119-128). Another strategy is to alter the sequence of the nucleic acid to be inserted into an expression vector so that the individual codons for each amino acid are those preferentially utilized in the bacterium chosen for expression, such as *C. glutamicum* (Wada et al., 1992, Nucleic Acids Res. 20:2111-2118). Such alteration of nucleic acid sequences of the invention can be carried out by standard DNA synthesis techniques.

In another embodiment, the SHSRP expression vector is a yeast expression vector. Examples of vectors for expression in yeast *S. cerevisiae* include pYepSec1 (Baldari, et al., 1987, EMBO J. 6:229-234), pMFa (Kurjan and Herskowitz, 1982, Cell 30:933-943), pJRY88 (Schultz et al., 1987, Gene 54:113-123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J., 1991, "Gene transfer systems and vector development for filamentous fungi," in: Applied Molecular Genetics of Fungi, J. F. Peberdy, et al., eds., p. 1-28, Cambridge University Press: Cambridge.

In a preferred embodiment of the present invention, the SHSRPs are expressed in plants and plants cells such as unicellular plant cells (e.g. algae) (See Falciatore et al., 1999, Marine Biotechnology 1(3):239-251 and references therein) and plant cells from higher plants (e.g., the spermatophytes, such as crop plants). An SHSRP may be "introduced" into a plant cell by any means, including transfection, transformation or transduction, electroporation, particle bombardment, agroinfection, and the like. One transformation method known to those of skill in the art is the dipping of a flowering plant into an *Agrobacteria* solution, wherein the *Agrobacteria* contain the SHSRP nucleic acid, followed by breeding of the transformed gametes.

Other suitable methods for transforming or transfecting host cells including plant cells can be found in Sambrook, et al. (Molecular Cloning: A Laboratory Manual. latest ed., Cold Spring Harbor Laboratory, Cold Spring Harbor Laboratory Press, Cold Spring Harbor, N.Y., 1989) and other laboratory manuals such as Methods in Molecular Biology, 1995, Vol. 44, *Agrobacterium* protocols, ed: Gartland and Davey, Humana Press, Totowa, N.J. As increased growth and increased biotic and abiotic stress tolerance are general traits wished to be inherited into a wide variety of plants like maize, wheat, rye, oat, triticale, rice, barley, *sorghum*, millet, sugarcane, soybean, peanut, cotton, rapeseed and canola, *manihot*, pepper, sunflower and tagetes, solanaceous plants like potato, tobacco, eggplant, and tomato, *Vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of an SHSRP into a plant is achieved by *Agrobacterium* mediated gene transfer. *Agrobacterium* mediated plant transformation can be performed using for example the GV3101 (pMP90) (Koncz and Schell, 1986, Mol. Gen. Genet. 204:383-396) or LBA4404 (Clontech) *Agrobacterium tumefaciens* strain. Transformation can be performed by standard transformation and regeneration techniques (Deblaere et al., 1994, Nucl. Acids. Res. 13:4777-4788; Gelvin, Stanton B. and Schilperoort, Robert A, Plant Molecular Biology Manual, 2*nd* Ed.—Dordrecht: Kluwer Academic Publ., 1995.—in Sect., Ringbuc Zentrale Signatur: BT11-P ISBN 0-7923-2731-4; Glick, Bernard R.; Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant Cell Report 8:238-242; De Block et al., 1989, Plant Physiol. 91:694-701). Use of antibiotics for *Agrobacterium* and plant selection depends on the binary vector and the *Agrobacterium* strain used for transformation. Rapeseed selection is normally performed using kanamycin as the selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. Nos. 5,376,543, or 5,169,770. Transformation of maize can be achieved by particle bombardment, polyethylene glycol mediated DNA uptake, or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced SHSRP may be maintained in the plant cell stably if it is incorporated into a non-chromosomal autonomous replicon or integrated into the plant chromosomes. Alternatively, the introduced SHSRP may be present on an extra-chromosomal non-replicating vector and may be transiently expressed or transiently active.

In one embodiment, a homologous recombinant microorganism can be created wherein the SHSRP is integrated into a chromosome, a vector is prepared which contains at least a portion of an SHSRP gene into which a deletion, addition, or substitution has been introduced to thereby alter, e.g., functionally disrupt, the SHSRP gene. Preferably, the SHSRP gene is any of SHSRP genes as provided in Table 1 and Table 2, but it can be a homolog from a related plant or yeast, or even from a mammalian or insect source. In one embodiment, the vector is designed such that, upon homologous recombination, the endogenous SHSRP gene is functionally disrupted (i.e., no longer encodes a functional polypeptide; also referred to as a knock-out vector). Alternatively, the vector can be designed such that, upon homologous recombination, the endogenous SHSRP gene is mutated or otherwise altered but still encodes a functional polypeptide (e.g., the upstream regulatory region can be altered to thereby alter the expression of the endogenous SHSRP). To create a point mutation via homologous recombination, DNA-RNA hybrids can be used in a technique known as chimeraplasty (Cole-Strauss et al., 1999, Nucleic Acids Research 27(5):1323-1330 and Kmiec, 1999, Gene Therapy American Scientist 87(3):240-247). Homologous recombination procedures in *Arabiodopsis thaliana*, for example, are well known in the art and are contemplated for use herein.

Whereas in the homologous recombination vector, the altered portion of the SHSRP gene is flanked at its 5' and 3' ends by an additional nucleic acid molecule of the SHSRP gene to allow for homologous recombination to occur between the exogenous SHSRP gene carried by the vector and an endogenous SHSRP gene, in a microorganism or plant. The additional flanking SHSRP nucleic acid molecule is of sufficient length for successful homologous recombination with the endogenous gene. Typically, several hundreds of base pairs up to kilobases of flanking DNA (both at the 5' and 3' ends) are included in the vector (See e.g., Thomas, K. R., and Capecchi, M. R., 1987, Cell 51:503 for a description of homologous recombination vectors). The vector is introduced into a microorganism or plant cell (e.g., via polyethylene glycol mediated DNA), and cells in which the introduced SHSRP gene has homologously recombined with the endogenous SHSRP gene are selected using art-known techniques.

In another embodiment, recombinant microorganisms can be produced that contain selected systems that allow for regulated expression of the introduced gene. For example, inclusion of an SHSRP gene on a vector placing it under control of the lac operon permits expression of the SHSRP gene only in the presence of IPTG. Such regulatory systems are well known in the art.

Whether present in an extra-chromosomal non-replicating vector or a vector that is integrated into a chromosome, the SHSRP polynucleotide preferably resides in a plant expression cassette. A plant expression cassette preferably contains regulatory sequences capable of driving gene expression in plant cells that are operatively linked so that each sequence can fulfill its function, for example, termination of transcription, for example, termination of transcription by polyadenylation signals. Preferred polyadenylation signals are those originating from *Agrobacterium tumefaciens* t-DNA such as the gene 3 known as octopine synthase of the Ti-plasmid pTiACH$_5$ (Gielen et al., 1984, EMBO J. 3:835) or functional equivalents thereof, but also all other terminators functionally active in plants are suitable. As plant gene expression is very often not limited on transcriptional levels, a plant expression cassette preferably contains other operatively linked sequences like translational enhancers such as the overdrive-sequence containing the 5'-untranslated leader sequence from tobacco mosaic virus enhancing the polypeptide per RNA ratio (Gallie et al., 1987, Nucl. Acids Research 15:8693-8711). Examples of plant expression vectors include those detailed in: Becker, D., Kemper, E., Schell, J. and Masterson, R., 1992, New plant binary vectors with selectable markers located proximal to the left border, Plant Mol. Biol. 20: 1195-1197; and Bevan, M. W., 1984, Binary *Agrobacterium* vectors for plant transformation, Nucl. Acid. Res. 12:8711-8721; Vectors for Gene Transfer in Higher Plants; in: Transgenic Plants, Vol. 1, Engineering and Utilization, eds.: Kung and R. Wu, Academic Press, 1993, S. 15-38.

Plant gene expression should be operatively linked to an appropriate promoter conferring gene expression in a timely, cell specific, or tissue specific manner. Promoters useful in the expression cassettes of the invention include any promoter that is capable of initiating transcription in a plant cell. Such promoters include, but are not limited to, those that can be obtained from plants, plant viruses, and bacteria that contain genes that are expressed in plants, such as *Agrobacterium* and *Rhizobium*.

The promoter may be constitutive, inducible, developmental stage-preferred, cell type-preferred, tissue-preferred, or organ-preferred. Constitutive promoters are active under most conditions. Examples of constitutive promoters include the CaMV 19S and 35S promoters (Odell et al., 1985, Nature 313:810-812), the sX CaMV 35S promoter (Kay et al., 1987, Science 236:1299-1302) the Sep1 promoter, the rice actin promoter (McElroy et al., 1990, Plant Cell 2:163-171), the *Arabidopsis* actin promoter, the ubiquitan promoter (Christensen et al., 1989, Plant Molec. Biol. 18:675-689), pEmu (Last et al., 1991, Theor. Appl. Genet. 81:581-588), the figwort mosaic virus 35S promoter, the Smas promoter (Velten et al., 1984, EMBO J. 3:2723-2730), the super-promoter (U.S. Pat. No. 5,955,646), the GRP1-8 promoter, the cinnamyl alcohol dehydrogenase promoter (U.S. Pat. No. 5,683,439), promoters from the T-DNA of *Agrobacterium*, such as mannopine synthase, nopaline synthase, and octopine synthase, the small subunit of ribulose biphosphate carboxylase (ssuRUBISCO) promoter, and the like.

Inducible promoters are preferentially active under certain environmental conditions, such as the presence or absence of a nutrient or metabolite, heat or cold, light, pathogen attack, anaerobic conditions, and the like. For example, the hsp80 promoter from *Brassica* is induced by heat shock; the PPDK promoter is induced by light; the PR-1 promoter from tobacco, *Arabidopsis*, and maize are inducible by infection with a pathogen; and the Adh1 promoter is induced by hypoxia and cold stress. Plant gene expression can also be facilitated via an inducible promoter (For review, see Gatz, 1997, Annu. Rev. Plant Physiol. Plant Mol. Biol. 48:89-108). Chemically inducible promoters are especially suitable if gene expression is wanted to occur in a time specific manner. Examples of such promoters are a salicylic acid inducible promoter (PCT Application No. WO 95/19443), a tetracycline inducible promoter (Gatz t al., 1992, Plant J. 2:397-404), and an ethanol inducible promoter (PCT Application No. WO 93/21334).

In one preferred embodiment of the present invention, the inducible promoter is a stress-inducible promoter. For the purposes of the invention, stress inducible promoters are preferentially active under one or more of the following stresses: sub-optimal conditions associated with salinity, drought, temperature, metal, chemical, pathogenic, and oxidative stresses. Stress inducible promoters include, but are not limited to, Cor78 (Chak et al., 2000, Planta 210:875-883; Hovath et al., 1993, Plant Physiol. 103:1047-1053), Cor15a (Artus et al., 1996, PNAS 93(23):13404-09), Rci2A (Medina et al., 2001, Plant Physiol. 125:1655-66; Nylander et al., 2001, Plant Mol. Biol. 45:341-52; Navarre and Goffeau, 2000, EMBO J. 19:2515-24; Capel et al., 1997, Plant Physiol. 115:569-76), Rd22 (Xiong et al., 2001, Plant Cell 13:2063-83; Abe t al., 1997, Plant Cell 9:1859-68; Iwasaki et al., 1995, Mol. Gen. Genet. 247:391-8), cDet6 (Lang and Palve, 1992, Plant Mol. Biol. 20:951-62), ADH1 (Hoeren et al., 1998, Genetics 149:479-90), KATI (Nakamura et al., 1995, Plant Physiol. 109:371-4), KSTI (Müller-Röber t al., 1995, EMBO 14:2409-16), Rha1 (Terryn et al., 1993, Plant Cell 5:1761-9; Terryn et al., 1992, FEBS Lett. 299(3):287-90), ARSK1 (Atkinson et al., 1997, GenBank Accession #L22302, and PCT Application No. WO 97/20057), PtxA (Plesch et al., GenBank Accession #X67427), SbHRGP3 (Ahn et al., 1996, Plant Cell 8:1477-90), GH3 (Liu et al., 1994, Plant Cell 6:645-57), the pathogen inducible PRP1-gene promoter (Ward et al., 1993, Plant. Mol. Biol. 22:361-366), the heat inducible hsp80-promoter from tomato (U.S. Pat. No. 5,187,267), cold inducible alpha-amylase promoter from potato (PCT Application No. WO 96/12814), or the wound-inducible pinII-promoter (European Patent No. 375091). For other examples of drought, cold, and salt-inducible promoters, such as the RD29A promoter, see Yamaguchi-Shinozalei et al., 1993, Mol. Gen. Genet. 236:331-340.

Developmental stage-preferred promoters are preferentially expressed at certain stages of development. Tissue and organ preferred promoters include those that are preferentially expressed in certain tissues or organs, such as leaves, roots, seeds, or xylem. Examples of tissue preferred and organ preferred promoters include, but are not limited to fruit-preferred, ovule-preferred, male tissue-preferred, seed-preferred, integument-preferred, tuber-preferred, stalk-preferred, pericarp-preferred, and leaf-preferred, stigma-preferred, pollen-preferred, anther-preferred, a petal-preferred, sepal-preferred, pedicel-preferred, silique-preferred, stem-preferred, root-preferred promoters, and the like. Seed preferred promoters are preferentially expressed during seed development and/or germination. For example, seed preferred promoters can be embryo-preferred, endosperm preferred, and seed coat-preferred. See Thompson et al., 1989, BioEssays 10:108. Examples of seed preferred promoters include, but are not limited to, cellulose synthase (celA), Cim1, gamma-zein, globulin-1, maize 19 kD zein (cZ19B1), and the like.

Other suitable tissue-preferred or organ-preferred promoters include the napin-gene promoter from rapeseed (U.S. Pat. No. 5,608,152), the USP-promoter from *Vicia faba* (Baeumlein et al., 1991, Mol. Gen. Genet. 225(3):459-67), the oleosin-promoter from *Arabidopsis* (PCT Application No. WO 98/45461), the phaseolin-promoter from *Phaseolus vulgaris* (U.S. Pat. No. 5,504,200), the Bce-4-promoter from *Brassica* (PCT Application No. WO 91/13980), or the legumin B4 promoter (LeB4; Bacumlein et al., 1992, Plant Journal, 2(2):233-9), as well as promoters conferring seed specific expression in monocot plants like maize, barley, wheat, rye, rice, etc. Suitable promoters to note are the lpt2 or lpt1-gene promoter from barley (PCT Application No. WO 95/15389 and PCT Application No. WO 95/23230) or those described in PCT Application No. WO 99/16890 (promoters from the barley hordein-gene, rice glutelin gene, rice oryzin gene, rice prolamin gene, wheat gliadin gene, wheat glutelin gene, oat glutelin gene, *Sorghum* kasirin-gene, and rye secalin gene).

Other promoters useful in the expression cassettes of the invention include, but are not limited to, the major chlorophyll a/b binding protein promoter, histone promoters, the Ap3 promoter, the β-conglycin promoter, the napin promoter, the soybean lectin promoter, the maize 15 kD zein promoter, the 22 kD zein promoter, the 27 kD zein promoter, the g-zein promoter, the waxy, shrunken 1, shrunken 2, and bronze promoters, the Zm13 promoter (U.S. Pat. No. 5,086,169), the maize polygalacturonase promoters (PG) (U.S. Pat. Nos. 5,412,085 and 5,545,546), and the SGB6 promoter (U.S. Pat. No. 5,470,359), as well as synthetic or other natural promoters.

Additional flexibility in controlling heterologous gene expression in plants may be obtained by using DNA binding domains and response elements from heterologous sources (i.e., DNA binding domains from non-plant sources). An example of such a heterologous DNA binding domain is the LexA DNA binding domain (Brent and Ptashne, 1985, Cell 43:729-736).

The invention further provides a recombinant expression vector comprising an SHSRP DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to an SHSRP mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus wherein antisense nucleic acids are produced under the control of a high efficiency regulatory region. The activity of the regulatory region can be determined by the cell type into which the vector is introduced. For a discussion of the regulation of gene expression using antisense genes, see Weintraub, H. et al., 1986, Antisense RNA as a molecular tool for genetic analysis, Reviews—Trends in Genetics, Vol. 1(1), and Mol et al., 1990, FEBS Letters 268:427-430.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, an SHSRP can be expressed in bacterial cells such as *C. glutamicum*, insect cells, fungal cells, or mammalian cells (such as Chinese hamster ovary cells (CHO) or COS cells), algae, ciliates, plant cells, fungi, or other microorganisms like *C. glutamicum*. Other suitable host cells are known to those skilled in the art.

A host cell of the invention, such as a prokaryotic or eukaryotic host cell in culture, can be used to produce (i.e., express) an SHSRP. Accordingly, the invention further provides methods for producing SHSRPs using the host cells of the invention. In one embodiment, the method comprises culturing the host cell of invention (into which a recombinant expression vector encoding an SHSRP has been introduced, or into which genome has been introduced a gene encoding a wild-type or altered SHSRP) in a suitable medium until the SHSRP is produced. In another embodiment, the method further comprises isolating SHSRPs from the medium or the host cell.

Another aspect of the invention pertains to isolated SHSRPs, and biologically active portions thereof. An "Isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of SHSRP in which the polypeptide is separated from some of the cellular components of the cells in which it is naturally or recombinantly produced. In one embodiment, the language "substantially free of cellular material" includes preparations of an SHSRP having less than about 30% (by dry weight) of non-SHSRP material (also referred to herein as a "contaminating polypeptide"), more preferably less than about 20% of non-SHSRP material, still more preferably less than about 10% of non-SHSRP material, and most preferably less than about 5% non-SHSRP material.

The nucleic acid molecules, polypeptides, polypeptide homologs, fusion polypeptides, primers, vectors, and host cells described herein can be used in one or more of the following methods: identification of any of the organisms as provided in Column No. 2 of Table 1 and Table 2 and related organisms; mapping of genomes of organisms related to any of the organisms as provided in Column No. 2 of Table 1 and Table 2; identification and localization of the sequences of interest of any of the organisms as provided in Column No. 2 of Table 1 and Table 2; evolutionary studies; determination of SHSRP regions required for function; modulation of an SHSRP activity; modulation of the metabolism of one or more cell functions; modulation of the transmembrane transport of one or more compounds; modulation of stress resistance; and modulation of expression of SHSRP nucleic acids. In one embodiment of these methods, the SHSRP functions as a serine hydroxymethyltransferase.

The SHSRP nucleic acid molecules according to the invention have a variety of uses. Most importantly, the nucleic acid and amino acid sequences of the present invention can be used to transform plants, particularly crop plants, thereby inducing tolerance to stresses such as drought, high salinity, and cold. The present invention therefore provides a transgenic plant transformed by an SHSRP nucleic acid, wherein expression of the nucleic acid sequence in the plant results in increased root growth and/or tolerance to environmental stress as compared to a wild type variety of the plant. The transgenic plant can be a monocot or a dicot. The invention further provides that the transgenic plant can be selected from maize, wheat, rye, oat, triticale, rice, barley, *sorghum*, millet, sugarcane, soybean, peanut, cotton, rapeseed, canola, *manihot*, pepper, sunflower, tagetes, solanaceous plants, potato, tobacco, eggplant, tomato, *Vicia* species, pea, alfalfa, coffee, cacao, tea, *Salix* species, oil palm, coconut, perennial grass, and forage crops, for example.

In particular, the present invention describes using the expression of SHSRP coding nucleic acids to engineer plants with increased root growth, and/or increased yield, and/or that are drought-tolerant, salt-tolerant, and/or cold-tolerant. This strategy has herein been demonstrated using AtSHMT4 (SEQ ID NO:1) in *Arabidopsis thaliana* and corn, but its application is not restricted to this gene or to these plants. Accordingly, the invention provides a transgenic crop plant containing an SHSRP as defined in any of SEQ ID NOS as provided in Column No. 4 of Table 1 and Table 2, wherein the plant has increased root growth, and/or increased yield, and/or increased tolerance to an environmental stress selected from one or more of the group consisting of drought, increased salt, or decreased or increased temperature. In preferred embodiments, the environmental stress is drought. In other preferred embodiments, the increased root growth is an increase in root length, preferably under water-limiting conditions.

The invention also provides a method of producing a transgenic crop plant containing an SHSRP coding nucleic acid, wherein expression of the nucleic acid(s) in the plant results in increased root growth, and/or increased yield, and/or increased tolerance to environmental stress as compared to a wild type variety of the plant comprising: (a) Introducing into a plant cell an expression vector comprising an SHSRP nucleic acid, and (b) generating from the plant cell a transgenic plant with a increased root growth, and/or increased yield, and/or increased tolerance to environmental stress as compared to a wild type variety of the plant. The plant cell includes, but is not limited to, a protoplast, gamete producing cell, and a cell that regenerates into a whole plant. As used herein, the term "transgenic" refers to any plant, plant cell, callus, plant tissue, or plant part that contains all or part of at least one recombinant polynucleotide. In many cases, all or part of the recombinant polynucleotide is stably integrated into a chromosome or stable extra-chromosomal element, so that it is passed on to successive generations. In preferred embodiments, the SHSRP nucleic acid encodes a protein comprising the polypeptide of any of SEQ ID NOS as provided in Column No. 4 of Table 1 and Table 2.

The present invention also provides a method of modulating a plant's root growth, and/or yield, and/or tolerance to an environmental stress comprising, modifying the expression of an SHSRP coding nucleic acid in the plant. The plant's root growth, and/or yield, and/or tolerance to the environmental stress can be increased or decreased as achieved by increasing or decreasing the expression of an SHSRP, respectively. Preferably, the plant's root growth, and/or yield, and/or tolerance to the environmental stress is increased by increasing expression of an SHSRP. Expression of an SHSRP can be modified by any method known to those of skill in the art. The methods of increasing expression of SHSRPs can be used wherein the plant is either transgenic or not transgenic. In cases when the plant is transgenic, the plant can be transformed with a vector containing any of the above described SHSRP coding nucleic acids, or the plant can be transformed with a promoter that directs expression of native SHSRP in the plant, for example. The invention provides that such a promoter can be tissue preferred, developmentally regulated, stress inducible, or a combination thereof. Alternatively, non-transgenic plants can have native SHSRP expression modified by inducing a native promoter. The expression of SHSRP as defined in any of SEQ ID NOS as provided in Column No. 4 of Table 1 and Table 2 in target plants can be accomplished by, but is not limited to, one of the following examples: (a) constitutive promoter, (b) stress-inducible promoter, (c) chemical-induced promoter, and (d) engineered promoter overexpression with, for example, zinc-finger derived transcription factors (Greisman and Pabo, 1997, Science 275:657).

In a preferred embodiment, transcription of the SHSRP is modulated using zinc-finger derived transcription factors (ZFPs) as described in Greisman and Pabo, 1997, Science 275:657 and manufactured by Sangamo Biosciences, Inc. These ZFPs comprise both a DNA recognition domain and a functional domain that causes activation or repression of a target nucleic acid such as an SHSRP nucleic acid. Therefore, activating and repressing ZFPs can be created that specifically recognize the SHSRP promoters described above and used to increase or decrease SHSRP expression in a plant, thereby modulating the yield and/or stress tolerance of the plant. The present invention also includes identification of the homologs of SHSRP coding nucleic acids as defined in any of SEQ ID NOS as provided in Column No. 3 of Table 1 and Table 2 in a target plant, as well as the homolog's promoter. The invention also provides a method of increasing expression of a gene of interest within a host cell as compared to a wild type variety of the host cell, wherein the gene of interest is transcribed in response to an SHSRP, comprising: (a) transforming the host cell with an expression vector comprising an SHSRP coding nucleic acid, and (b) expressing the SHSRP within the host cell, thereby increasing the expression of the gene transcribed in response to the SHSRP, as compared to a wild type variety of the host cell.

In addition to introducing the SHSRP nucleic acid sequences into transgenic plants, these sequences can also be used to identify an organism as being any of the organisms as provided in Column No. 2 of Table 1 and Table 2, or a close relative thereof. Also, they may be used to identify the presence of any of the organisms as provided in Column No. 2 of Table 1 and Table 2, or a relative thereof in a mixed population of organisms. The invention relates to the nucleic acid sequences of a number of genes from any of the organisms as provided in Column No. 2 of Table 1 and Table 2; by probing the extracted genomic DNA of a culture of a unique or mixed population of organisms under stringent conditions with a probe spanning a region of a particular gene that is unique to the corresponding organism according to Table 1 and Table 2, one can ascertain whether this organism is present.

Further, the nucleic acid and polypeptide molecules according to the invention may serve as markers for specific regions of the genome. This has utility not only in the mapping of the genome, but also in functional studies of the polypeptides encoded by such genome. For example, to identify the region of the genome to which a particular organism's DNA-binding polypeptide binds, the organism's genome could be digested, and the fragments incubated with the DNA-binding polypeptide. Those fragments that bind the polypeptide may be additionally probed with the nucleic acid molecules of the invention, preferably with readily detectable labels. Binding of such a nucleic acid molecule to the genome fragment enables the localization of the fragment to the genome map of such an organism and, when performed multiple times with different enzymes, facilitates a rapid determination of the nucleic acid sequence to which the polypeptide binds. Further, the nucleic acid molecules of the invention may be sufficiently identical to the sequences of related species such that these nucleic acid molecules may serve as markers for the construction of a genomic map in related plants.

The SHSRP nucleic acid molecules of the invention are also useful for evolutionary and polypeptide structural studies. The vesicle trafficking processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the polypeptide that are essential for the functioning of the enzyme. This type of determination is of value for polypeptide engineering studies and may give an indication of what the polypeptide can tolerate in terms of mutagenesis without losing function.

Manipulation of the SHSRP nucleic acid molecules of the invention may result in the production of SHSRPs having functional differences from the wild-type SHSRPs. These polypeptides may be improved in efficiency or activity, may be present in greater numbers in the cell than is usual, or may be decreased in efficiency or activity.

There are a number of mechanisms by which the alteration of an SHSRP of the invention may directly affect root growth and/or yield and/or stress response and/or stress tolerance. In the case of plants expressing SHSRPs, overexpression of SHMT4 may provide a higher source of one-carbon units for cellular biosynthetic reactions in the cytosol and chloroplasts, which may increase synthesis of building blocks as methlonine, purines, pyrimidines, and lipids, leading to an increase in root length and improved plant water use efficiency.

The effect of the genetic modification in plants, *C. glutamicum*, fungi, algae, or ciliates on root growth and/or stress tolerance can be assessed by growing the modified microorganism or plant under less than suitable conditions and then analyzing the growth characteristics and/or metabolism of the plant. Such analysis techniques are well known to one skilled in the art, and include dry weight, wet weight, polypeptide synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, vol. 17; Rehm et al., 1993 Biotechnology, vol. 3, Chapter III: Product recovery and purification, page 469-714, VCH: Weinhelm; Belter, P. A. et al., 1988, Bioseparations: downstream processing for biotechnology, John Wiley and Sons; Kennedy, J. F. and Cabral, J. M. S., 1992, Recovery processes for biological materials, John Wiley and Sons; Shaeiwitz, J. A. and Henry, J. D., 1988, Biochemical separations, in: Ulmann's Encyclopedia of Industrial Chemistry, vol. B3, Chapter II, page 1-27, VCH: Weinheim; and Dechow, F. J., 1989, Separation and purification techniques in biotechnology, Noyes Publications).

For example, yeast expression vectors comprising the nucleic acids disclosed herein, or fragments thereof, can be constructed and transformed into *Saccharomyces cerevisiae* using standard protocols. The resulting transgenic cells can then be assayed for fail or alteration of their increased growth and/or tolerance to drought, salt, and temperature stresses. Similarly, plant expression vectors comprising the nucleic acids disclosed herein, or fragments thereof, can be constructed and transformed into an appropriate plant cell such as *Arabidopsis*, soy, rape, maize, wheat, *Medicago truncatula*, etc., using standard protocols. The resulting transgenic cells and/or plants derived there from can then be assayed for fail or alteration of their increased root growth and/or tolerance to drought, salt, and temperature stresses.

Additionally, the sequences disclosed herein, or fragments thereof, can be used to generate knockout mutations in the genomes of various organisms, such as bacteria, mammalian cells, yeast cells, and plant cells (Girke, T., 1998, The Plant Journal 15:39-48). The resultant knockout cells can then be evaluated for their ability or capacity to tolerate various stress conditions, their response to various stress conditions, and the effect on the phenotype and/or genotype of the mutation. For other methods of gene inactivation, see U.S. Pat. No. 6,004,804 "Non-Chimeric Mutational Vectors" and Puttaraju et al., 1999, Spliceosome-mediated RNA tras-splicing as a tool for gene therapy, Nature Biotechnology 17:246-252.

The aforementioned mutagenesis strategies for SHSRPs resulting in increased root growth, and/or yield, and/or stress tolerance are not meant to be limiting; variations on these strategies will be readily apparent to one skilled in the art. Using such strategies, and incorporating the mechanisms disclosed herein, the nucleic acid and polypeptide molecules of the invention may be utilized to generate algae, ciliates, plants, fungi, or other microorganisms like *C. glutamicum* expressing mutated SHSRP nucleic acid and polypeptide molecules such that the root growth and/or stress tolerance is improved.

The present invention also provides antibodies that specifically bind to an SHSRP, or a portion thereof, as encoded by a nucleic acid described herein. Antibodies can be made by many well-known methods (See, e.g., Harlow and Lane, "Antibodies; A Laboratory Manual," Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. (See, for example, Kelly et al., 1992, Bio/Technology 10:163-167; Bebbington et al., 1992, BioTechnology 10:169-175).

The phrases "selectively binds" and "specifically binds" with the polypeptide refer to a binding reaction that is determinative of the presence of the polypeptide in a heterogeneous population of polypeptides and other biologics. Thus, under designated immunoassay conditions, the specified antibodies bound to a particular polypeptide do not bind in a significant amount to other polypeptides present in the sample. Selective binding of an antibody under such conditions may require an antibody that is selected for Its specificity for a particular polypeptide. A variety of immunoassay formats may be used to select antibodies that selectively bind with a particular polypeptide. For example, solid-phase ELISA immunoassays are routinely used to select antibodies selectively immunoreactive with a polypeptide. See Harlow and Lane, "Antibodies, A Laboratory Manual" Cold Spring Harbor Publications, New York, (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., eds., "Basic and Clinical Immunology," (Lange Medical Publications, Los Altos, Calif., Fourth Edition) and references cited therein, and in Harlow and Lane "Antibodies, A Laboratory Manual" Cold Spring Harbor Publications, New York, 1988.

Throughout this application, various publications are referenced. The disclosures of all of these publications and those references cited within those publications in their entireties are hereby incorporated by reference into this application in order to more fully describe the state of the art to which this invention pertains.

It should also be understood that the foregoing relates to preferred embodiments of the present invention and that numerous changes may be made therein without departing from the scope of the invention. The invention is further illustrated by the following examples, which are not to be construed in any way as imposing limitations upon the scope thereof. On the contrary, it is to be clearly understood that resort may be had to various other embodiments, modifications, and equivalents thereof, which, after reading the description herein, may suggest themselves to those skilled in the art without departing from the spirit of the present invention and/or the scope of the appended claims.

EXAMPLES

Example 1

Total DNA Isolation from Plant Material

The details for the isolation of total DNA relate to the working up of one gram fresh weight of plant material. The materials used include the following buffers: CTAB buffer: 2% (w/v) N-cethyl-N,N,N-trimethylammonium bromide (CTAB); 100 mM Tris HCl pH 8.0; 1.4 M NaCl; 20 mM EDTA; N-Laurylsarcosine buffer: 10% (w/v) N-laurylsarcosine; 100 mM Tris HCl pH 8.0; and 20 mM EDTA.

The plant material was triturated under liquid nitrogen in a mortar to give a fine powder and transferred to 2 mil Eppendorf vessels. The frozen plant material was then covered with a layer of 1 ml of decomposition buffer (1 ml CTAB buffer, 100 µl of N-laurylsarcosine buffer, 20 µl of β-mercaptoethanol, and 10 µl of proteinase K solution, 10 mg/ml) and incubated at 60° C. for one hour with continuous shaking. The homogenate obtained was distributed into two Eppendorf vessels (2 ml) and extracted twice by shaking with the same volume of chloroform/isoamyl alcohol (24:1). For phase separation, centrifugation was carried out at 8000×g and room temperature for 15 minutes in each case. The DNA was then precipitated at −70° C. for 30 minutes using ice-cold isopropanol. The precipitated DNA was sedimented at 4° C. and 10,000 g for 30 minutes and resuspended in 180 µl of TE buffer (Sambrook et al., 1989, Cold Spring Harbor Laboratory Press: ISBN 0-87969-309-6). For further purification, the DNA was treated with NaCl (1.2 M final concentration) and precipitated again at −70° C. for 30 minutes using twice the volume of absolute ethanol. After a washing step with 70% ethanol, the DNA was dried and subsequently taken up in 50 µl of $H_2O$+RNAse (50 mg/ml final concentration). The DNA was dissolved overnight at 4° C., and the RNAse digestion was subsequently carried out at 37° C. for 1 hour. Storage of the DNA took place at 4° C.

Example 2

Isolation of Total RNA and cDNA from *Arabidopsis* Plant Material

AtSHMT4 was isolated by preparing RNA from *Arabidopsis* leaves using the RNA mini-isolation kit (Qiagen kit) following the manufacturer's recommendations. Reverse transcription reactions and amplification of the cDNA were performed as described below.

1. Use 2 µl of RNA (0.5-2.0 µg) preparation in a 10 µl Dnase reaction, move the tube to 370° C. for 15 minutes, add 1 µl 25 mM EDTA, and then heat reaction to 65° C. for 15 minutes.
   a. Buffer (10×: 200 mM Tris, 500 mM KCl, 20 mM MgCl$_2$)—1 µl
   b. RNA—2 µl
   c. Dnase (10 U/µl)—1 µl
   d. H$_2$O—6 µl
2. Use 1 µl of the above reaction in a room temperature reaction, and heat to 65° C. for 5 minutes.
   a. Dnased RNA (0.025-0.1 µg depending on the starting amount)—1 µl
   b. 10 mM dNTPs—1 µl
   c. Primer (10 µM)—1 µl
   d. H$_2$O—up to 10 µl
3. Prepare a reaction mix with these reagents in a separate tube
   a. SuperScript II RT buffer (10×)—2 µl
   b. 25 mM MgCl$_2$—4 µl
   c. DTT (0.1 M)—2 µl
   d. Rnase Out Rnase Inhibitor (40 U/µl)—1 µl
4. Add the 9 µl reaction mix to the denatured RNA solution, and hold at 42° C. for 2 minutes.
5. Add 1 µl of SuperScriptII RT (50 U/µl), and incubate at 42° C. for 50 minutes.
6. Terminate reaction at 70° C. for 15 minutes.
7. Optional: add 1 µl of RNAseH to reaction to remove RNA.
8. Perform PCR as you would using 1-2 µl of the new cDNA.

Tissue Harvest, RNA Isolation, and cDNA Library Construction

Crop plants were grown under a variety of conditions and treatments, and different tissues were harvested at various developmental stages. Plant growth and harvesting were done in a strategic manner such that the probability of harvesting all expressible genes in at least one or more of the resulting libraries is maximized. The mRNA was isolated as described above from each of the collected samples, and cDNA libraries were constructed. No amplification steps were used in the library production process in order to minimize redundancy of genes within the sample and to retain expression information. All libraries were 3' generated from mRNA purified on oligo dT columns. Colonies from the transformation of the cDNA library into *E. coli* were randomly picked and placed into microtiter plates.

PCR Amplification of cDNA Inserts and Spotting

The cDNA Inserts from each clone from the microtiter plates were PCR amplified. Plasmid DNA was isolated from the *E. coli* colonies and then spotted on membranes. No purification step was necessary prior to spotting samples to nylon membranes.

Example 3

Cloning of AtSHMT4

The cDNA isolated as described in Example 2 was used to clone the AtSHMT4 gene by RT-PCR. The following primers were used: The forward primer was 5'-ATGOAAC-CAGTCTCTTCATG-3' (SEQ ID NO:159). The reverse primer was 5'-CTAATCCTTGTACTTCATCT-3' (SEQ ID NO:160). PCR reactions for the amplification included: 1×PCR buffer, 0.2 mM dNTP, 100 ng *Arabidopris thaliana* DNA, 25 µmol reverse primer, 2.5 u Pfu or Herculase DNA polymerase.

PCR was performed according to standard conditions and to manufacturer's protocols (Sambrook et al., 1989, Molecular Cloning, A Laboratory Manual, 2nd Edition, Cold Spring Harbor Laboratory Press, Cold Spring Harbor, N.Y., Biometra T3 Thermocycler). The parameters for the reaction were: 1 cycle for 3 minutes at 94° C.; followed by 25 cycles of 30 seconds at 94° C., 30 seconds at 55° C., and 1.5 minutes at 72° C.

The amplified fragments were then extracted from agarose gel with a QIAquick Gel Extraction Kit (Qiagen) and ligated into the TOPO pCR 2.1 vector (Invitrogen) following manufacture's instructions. Recombinant vectors were transformed into Top10 cells (Invitrogen) using standard conditions (Sambrook et al. 1989. Molecular Cloning, A Laboratory Manual, 2nd Edition, Cold Spring Harbor Laboratory Press, Cold Spring Harbor, N.Y.). Transformed cells were selected for on LB agar containing 100 µg/ml carbenicillin, 0.8 mg X-gal (5-bromo-4-chloro-3-indolyl-β-D-galactoside) and 0.8 mg IPTG (isopropylthio-β-D-galactoside) grown overnight at 37° C. White colonies were selected and used to inoculate 3 ml of liquid LB containing 100 µg/ml ampicillin and grown overnight at 37° C. Plasmid DNA was extracted using the QIAprep Spin Miniprep Kit (Qiagen) following manufacture's instructions. Analyses of subsequent clones and restriction mapping were performed according to standard molecular biology techniques (Sambrook et al., 1989, Molecular Cloning, A Laboratory Manual, 2nd Edition, Cold Spring Harbor Laboratory Press, Cold Spring Harbor, N.Y.).

The clones were sequenced, which confirmed that the identity of the cloned gene was identical to the sequence deposited in the *Arabidopsis thaliana* database (SEQ ID NO:1). The deduced amino acid sequence of AtSHMT4 is shown at SEQ ID NO:2.

The AtSHMT4 gene was then cloned into a binary vector and expressed under the Superpromoter (FIG. 3). The Superpromoter is constitutive, but root preferential (U.S. Pat. Nos. 5,428,147 and 5,217,903).

Example 4

*Arabidopsis* Plant Transformation

Transgenic *Arabidopsis thaliana* (Col) plants were generated by the dipping infiltration method (Bechtold et al., 1993, "In planta Agrobacterium-mediated gene transfer by infiltration of adult *Arabidopsis thaliana* plants," C. R. Acad. Sci. Paris Life Sci. 316:1194-1199). The binary vectors were transformed into *Agrobacteria* strain C58C1 or pMP90 using electroporation. Culture of the transformed *Agrobacteria* was grown, and the bacteria was resuspended in dipping infiltration media (½ MS, 5% sucrose, 0.5 mg/ml MES, pH 5.7 and with 200 ppm Sihwet L-77 (Lehle Seeds) added.) Each culture was used to transform 3 pots of approximately 5 week-old Col0 *Arabidopsis* plants by dipping pots 5 minutes each in resuspended *Agrobacterium* cultures. The plants were then grown to seed under standard *Arabidopsis* conditions (23° C. day/20° C. night, 18 hour day and 65% humidity). T1 seeds were screened on MS plates using 100 nM Pursuit (BASF).
Screening of Transformed Plants T1 seeds were sterilized according to standard protocols (Xiong et al., 1999, Plant Molecular Biology Reporter 17: 159-170). Seeds were selected on ½ Murashige and Skoog media (MS) (Sigma-Aldrich), 0.6% agar and supplemented with 1% sucrose, and 2 µg/ml benomyl (Sigma-Aldrich). Seeds on plates were vernalized for four days at 4° C. The seeds were germinated in a climatic chamber at an air temperature of 22° C. and light Intensity of 40 micromols$^{-1m2}$ (white light; Philips TL 65W/25 fluorescent tube) and 16 hours light and 8 hours dark day length cycle. Transformed seedlings were selected after 14 days and transferred to ½ MS media supplemented with 0.6% agar, 1% sucrose, and allowed to recover for five to seven days.

Seeds of T2 generation were used for plant root analysis in soil and in vitro.

Example 5

In Vitro Root Analysis of Transformed *Arabidopsis* Plants

For in vitro root analysis of transformed plants, square plates measuring 12 cm×12 cm were used. For each plate, 52 ml of MS media (0.5× MS salts, 0.5% sucrose, 0.5 g/L MES buffer, 1% Phytagar) without selection was used. Plates were allowed to dry in the sterile hood for one hour to reduce future condensation.

Seed aliquots were sterilized in glass vials with ethanol for 5 minutes, the ethanol was removed, and the seeds were allowed to dry in the sterile hood for one hour. Seeds were spotted in the plates using the Vacuseed Device (Lehle). In the experimental design, every plate contained both wild type and AtSHMT4 transgenic plants. Therefore, every line was always compared to the controls grown in the same plate(s) to account for microenvironment variation. After the seeds were spotted on the plates, the plates were wrapped with Ventwrap and placed vertically in racks in the dark at 4° C. for four days to stratify the seeds. The plates were transfered to a C5 Percival Growth Chamber and placed vertically for fourteen days. The growth chamber conditions were 23° C. day/21° C. night and 16 hour days/8 hour nights.

For data collection a high resolution flat-bed scanner was used. Analysis of the roots was done using the WinRhizo software package.

In in vitro analysis, roots were measured as length of the primary root at 14 days after germination. This corresponds to a 4 to 6 leaf stage in the *Arabidopsis* ecotype Columbia. Any difference observed could indicate a growth rate difference in the root growth, but could also reflect the final root growth.

The results of these experiments were also analyzed at the gene level. To do this, root length of all plants for all transgenic lines was averaged and compared against the average of the wild type plants. Presence of the transgene and copy number of the events were determined targeting the NOS terminator in real time PCR. The NOS Primers used for the analysis were: Forward primer 5'-TCCCCGATCGT-TCAAACATT-3' (SEQ ID NO:161), Reverse primer 5'-CCATCTCATAAATAACOTCATGCAT-3' (SEQ ID NO: 162). The reactions were run in a 96-well optical plate (Applied Blosystems, 4314320), and the endogenous control and gene of interest reactions were run on the same plate simultaneously. A master mix was made for both primer sets. The master mixes and the 96-well plate for assay should be kept on ice. Calculations are included for 52 reactions, which is suitable for half of the plate with use of a multichannel pipetter. The Eurogentec kit, (cat#RTSNRT032X-1) was used, and reactions were prepared using manufacturer's recommendations. A GeneAmp 5700 was used to run the reactions and collect data.
Results Our results show that transgenic AtSHMT4 plants evaluated in plates have a longer root phenotype. FIG. 4A shows the results of the plants grown in vertical plates on a per line basis. The majority of AtSHMT4 transgenic lines screened exhibited a longer root phenotype in comparison to wild-type control plant roots. The phenotype was more clearly observed in lines 3, 6, 7, 8, and 9.

The gene level analysis of the AtSHMT4 transgenic plants, as seen in FIG. 4B, confirmed that the AtSHMT4 plants exhibited an increased root length phenotype. Based on this analysis, SHMT4 transgenic *Arabidopsis* plants exhibited a 8.4% increase in root length.

Example 6

Soil Root Analysis of Transformed *Arabidopsis* Plants

For soil root analysis, seeds were imbibed at 4° C. for 2 days in water and were planted directly in soil with no selection. Deepots (Hummert D40) were used with a saturated peat pellet (Jiffy 727) at the base and filled with water saturated Metromix. After planting, pots were covered with plastic wrap to prevent drying. Plants were grown using only water present at media preparation, as the water in the soil in these large pots is sufficient for 3 weeks of growth, and encourages rapid root growth. The plastic wrapping of the pots was removed after 12 days and morphological data was documented. At day 17 the aerial parts of the plant were harvested, dried at 65° C. for 2 days and the dry weight was measured. To examine the roots, the peat pellet was pushed towards the top of the pot to remove the soil and roots as a unit. The soil was then separated from the roots in a tray and the maximum root length was measured.

To determine the impact of the root phenotype in the above ground tissues of the transgenic plants, the dry weight of the rosette was measured and compared against the wild type plants.
Results Roots of the AtSHMT4 lines were also evaluated in soil as described above. The results indicated transgenic plants exhibited a longer root phenotype when plants are grown in soil (FIGS. 5 and 6). In general, all AtSHMT4 lines analyzed exhibited increased growth in the soil-based assay. Lines G2, G3, G6, G8 and 010 showed the greatest increase in root length (FIG. 5).

FIG. 6 shows the ANOVA of the overall performance of the AtSHMT4 gene, demonstrating that the AtSHMT4 transgenic plants performed significantly better than the wild type controls.

The dry weight of the rosette was measured, and the ANOVA analysis of the results is shown in FIG. 7. No significant differences were observed between the transgenic plants and the wild type controls. Therefore the rosette biomass does not appear to be affected by the overexpression of the AtSHMT4 gene.

Example 7

Identificalion of Homologs to AtSHMT4

The algorithms used in the present invention include: FASTA (Very sensitive sequence database searches with estimates of statistical significance; Pearson, 1990, Rapid and sensitive sequence comparison with FASTP and FASTA, Methods Enzymol. 183:63-98); BLAST (Very sensitive sequence database searches with estimates of statistical significance; Altschul et al., Basic local alignment search tool, Journal of Molecular Biology 215:403-10); PREDATOR (High-accuracy secondary structure prediction from single and multiple sequences; Frishman and Argos, 1997, 75% accuracy in protein secondary structure prediction. Proteins 27:329-335); CLUSTALW (Multiple sequence alignment; Thompson et al., 1994, CLUSTAL W (improving the sensitivity of progressive multiple sequence alignment through sequence weighting, positions-specific gap penalties and weight matrix choice), Nucleic Acids Research 22:4673-4680); TMAP (Transmembrane region prediction from multiply aligned sequences; Persson and Argos, 1994, Prediction of transmembrane segments in proteins utilizing multiple sequence alignments, J. Mol. Biol. 237:182-192); ALOM2 (Transmembrane region prediction from single sequences; Klein et al., Prediction of protein function from sequence properties: A discriminate analysis of a database. Biochim. Biophys. Acta 787:221-226 (1984). Version 2 by Dr. K. Nakai); PROSEARCH (Detection of PROSITE protein sequence patterns; Kolakowski et al., 1992, ProSearch: fast searching of protein sequences with regular expression patterns related to protein structure and function. Biotechniques 13, 919-921); BLIMPS (Similarity searches against a database of ungapped blocks, Wallace and Henikoff, 1992); PATMAT (a searching and extraction program for sequence, pattern and block queries and databases, CABIOS 8:249-254. Written by Bill Alford).

Homologs of the AtSHMT4 gene were found in the public and proprietary databases. These homologs were evaluated to determine the level of relationship to AtSHMT4. The tblastn program from the BLAST family of algorithms was used to compare the AtSHMT4 amino acid sequence against the proprietary crop database translated in all six reading frames. Sequences with significant homology were found in each crop library. The sequence identity percentage at amino acid level of each sequence as compared to AtSHMT4 is shown in Column No. 5 of Table 1 and Table 2.

The BLAST alignments between AtSHMT4 and SHSRP from crops such as canola, soybean, sunflower, wheat, maize, linseed, rice and barley are shown in FIGS. 9-16. An alignment of each of these sequences is shown in FIG. 17. For alignment analysis, pair wise comparisons were done with a gap opening penalty of 10 and gap extension penalty of 0.1. Multiple alignments were done with gap opening penalty of 10 a gap extension penalty of 0.05 and a gap separation penalty rate of 8.

Example 8

Engineering Soybean Plants by Overexpressing the SHMT4 Gene

Seeds of soybean are surface sterilized with 70% ethanol for 4 minutes at room temperature with continuous shaking, followed by 20% (v/v) Clorox supplemented with 0.05% (v/v) Tween for 20 minutes with continuous shaking. Then, the seeds are rinsed 4 times with distilled water and placed on moistened sterile filter paper in a Petri dish at room temperature for 6 to 39 hours. The seed coats are peeled off, and cotyledons are detached from the embryo axis. The embryo axis is examined to make sure that the meristematic region is not damaged. The excised embryo axes are collected in a half-open sterile Petri dish and air-dried to a moisture content less than 20% (fresh weight) in a sealed Petri dish until further use.

*Agrobacterium tumefaciens* culture is prepared from a single colony in LB solid medium plus appropriate selection agents followed by growth of the single colony in liquid LB medium to an optical density at 600 nm of 0.8. Then, the bacteria culture is pelleted at 7000 rpm for 7 minutes at room temperature, and resuspended in MS medium supplemented with 100 µM acetosyringone. Bacteria cultures are incubated in this pre-induction medium for 2 hours at room temperature before use. The axis of soybean zygotic seed embryos at approximately 15% moisture content are imbibed for 2 hours at room temperature with the pre-induced *Agrobacterium* suspension culture. The embryos are removed from the imbibition culture and are transferred to Petri dishes containing solid MS medium supplemented with 2% sucrose and incubated for 2 days in the dark at room temperature. Alternatively, the embryos are placed on top of moistened (liquid MS medium) sterile filter paper in a Petri dish and incubated under the same conditions described above. After this period, the embryos are transferred to either solid or liquid MS medium supplemented with 500 mg/L carbenicillin or 300 mg/L cefotaxime to kill the *Agrobacteria*. The liquid medium is used to moisten the sterile filter paper. The embryos are incubated during 4 weeks at 25° C., under 150 µmol m$^{-2}$ sec$^{-1}$ and 12 hours photoperiod. Once the seedlings produce roots, they are transferred to sterile metromix soil. The medium of the in vitro plants is washed off before transferring the plants to soil. The plants are kept under a plastic cover for 1 week to favor the acclimatization process. Then the plants are transferred to a growth room where they are incubated at 25° C., under 150 µmol m$^{-2}$sec$^{-1}$ light intensity and 12 hours photoperiod for about 80 days.

The transgenic plants are screened for their improved root growth and/or stress tolerance, demonstrating that transgene expression confers stress tolerance and/or increased water use efficiency.

Example 9

Engineering Rapeseed/Canola Plants by Overexpressing the SHMT4 Gene

The method of plant transformation described herein is applicable to *Brassica* and other crops. Seeds of canola are surface sterilized with 70% ethanol for 4 minutes at room temperature with continuous shaking, followed by 20% (v/v) Clorox supplemented with 0.05% (v/v) Tween for 20 minutes, at room temperature with continuous shaking. Then, the seeds are rinsed 4 times with distilled water and placed on moistened sterile filter paper in a Petri dish at room temperature for 18 hours. Then the seed coats are removed, and the seeds are air dried overnight in a half-open sterile Petri dish. During this period, the seeds lose approximately 85% of their water content. The seeds are then stored at room temperature in a sealed Petri dish until further use. DNA constructs and embryo imbibition are as described in Example 10. Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants are screened for their improved root growth and/or stress tolerance, demonstrating that transgene expression confers stress tolerance and/or increased water use efficiency.

Example 10

Engineering Corn Plants by Overexpressing the SHMT4 Gene

Transformation of maize (*Zea Mays* L) with the gene of interest was performed with the method described by Ishida et al., 1996, Nature Biotech. 14745-50. Immature embryos are co-cultivated with Agrobacterlum umnefaciens that carry "super binary" vectors, and transgenic plants are recovered through organogenesis. This procedure provides a transformation efficiency of between 2.5% and 20%. The transgenic plants are screened for their improved root growth and/or stress tolerance, demonstrating that transgene expression confers stress tolerance and/or increased water use efficiency.

Example 11

Engineering Rice Plants by Overexpressing the SHMT4 Gene

Transformation of rice with the gene of interest can be undertaken by direct gene transfer techniques utilizing protoplasts or particle bombardment. Protoplast-mediated transformation has been described for Japonica-types and Indica-types (Zhang et al., Plant Cell Rep 7: 379-384 (1988); Shimamoto et al. Nature 338: 274-277 (1989); Datta et al. Biotechnology 8: 736-740 (1990)). Both types are also routinely transformable using particle bombardment (Christou et al. Biotechnology 9: 957-962 (1991)). The transgenic plants are screened for their improved growth and/or stress tolerance, demonstrating that transgene expression confers stress tolerance and/or increased water use efficiency.

Example 12

Identification of Homologous and Heterologous Genes

Gene sequences can be used to identify homologous or heterologous genes from cDNA or genomic libraries. Homologous genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by, e.g., UV cross linking. Hybridization is carried out at high stringency conditions. In aqueous solution, hybridization and washing is performed at an ionic strength of 1 M NaCl and a temperature of 68° C. Hybridization probes are generated by, e.g., radioactive ($^{32}$P) nick transcription labeling (High Prime, Roche, Mannheim, Germany). Signals are detected by autoradiography.

Partially homologous or heterologous genes that are related but not identical can be identified in a manner analogous to the above-described procedure using low stringency hybridization and washing conditions. For aqueous hybridization, the ionic strength is normally kept at 1 M NaCl while the temperature is progressively lowered from 68 to 42° C.

Isolation of gene sequences with homologies (or sequence identity/similarity) only in a distinct domain of (for example 10-20 amino acids) can be carried out by using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are then radiolabeled by, for example, nick transcription. Hybridization is normally performed at low stringency conditions using high oligonucleotide concentrations.

Oligonucleotide hybridization solution:
6×SSC
0.01 M sodium phosphate
1 mM EDTA (pH 8)
0.5% SDS
100 μg/m denatured salmon sperm DNA
0.1% nonfat dried milk During hybridization, the temperature is lowered stepwise to 5-10° C. below the estimated oligonucleotide $T_m$, or down to room temperature, followed by washing steps and autoradiography. Washing is performed with low stringency, such as 3 washing steps using 4×SSC. Further details are described by Sambrook, J. et al., 1989, "Molecular Cloning: A Laboratory Manual", Cold Spring Harbor Laboratory Press or Ausubel, F. M. et al., 1994, "Current Protocols in Molecular Biology", John Wiley & Sons.

Example 13

Identification of Homologous Genes by Screening Expression Libraries with Antibodies c-DNA clones can be used to produce recombinant protein for example in *E. coli* (e.g. Qiagen QIAexpress pQE system). Recombinant proteins are then normally affinity purified via Ni-NTA affinity chromatography (Qiagen). Recombinant proteins are then used to produce specific antibodies for example by using standard techniques for rabbit immunization. Antibodies are affinity purified using a Ni-NTA column saturated with the recombinant antigen as described by Gu et al., 1994, BioTechniques 17:257-262. The antibody can be used to screen expression cDNA libraries to identify homologous or heterologous genes via an immunological screening (Sambrook, J. et al., 1989, "Molecular Cloning: A Laboratory Manual", Cold Spring Harbor Laboratory Press or Ausubel, F. M. et al., 1994, "Current Protocols in Molecular Biology", John Wiley & Sons).

Example 14

In vivo Mutagenesis

In vivo mutagenesis of microorganisms can be performed by passage of plasmid (or other vector) DNA through & coil or other microorganisms (e.g. *Bacillus* spp. or yeasts such as *Saccharonyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D., 1996, DNA repair mechanisms, in: *Escherichia coli* and *Salmonella*, p. 2277-2294, ASM: Washington.) Such strains are well known to those skilled in the art. The use of such strains is illustrated, for example, in Greener, A. and Callahan, M., 1994, Strategies 7:32-34. Transfer of mutated DNA molecules into plants is preferably done after selection and testing in microorganisms. Transgenic plants are generated according to various examples within the exemplification of this document.

Example 15

In Vitro Analysis of the Function of *Arabidopsis* Genes in Transgenic Organisms The determination of activities and kinetic parameters of enzymes is well established in the art. Experiments to determine the activity of any given altered enzyme must be tailored to the specific activity of the wild-type enzyme, which is well within the ability of one skilled In the art. Overviews about enzymes in general, as well as specific details concerning structure, kinetics, principles, methods, applications, and examples for the determination of many enzyme activities may be found, for example, in the following references: Dixon, M., and Webb, E. C., 1979, Enzymes. Longmans: London; Fersht, 1985, Enzyme Structure and Mechanism. Freeman: New York; Walsh, 1979, Enzymatic Reaction Mechanisms. Freeman: San Francisco; Price, N. C., Stevens, L., 1982, Fundamentals of Enzymology. Oxford Univ. Press: Oxford; Boyer, P. D., ed., 1983, The Enzymes, $3^{rd}$ ed. Academic Press: New York; Bisswanger, H., 1994, Enzymkinetik, $2^{nd}$ ed. VCH: Weinheim (ISBN 3527300325); Bergmeyer, H. U., Bergmeyer, J., Graβl, M., eds., 1983-1986, Methods of Enzymatic Analysis, $3^{rd}$ ed., vol. I-XII, Verlag Chemle: Weinheim; and Ullmann's Encyclopedia of Industrial Chemistry, 1987, vol. A9, Enzymes. VCH: Weinheim, p. 352-363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al., 1995, EMBO J. 14: 3895-3904 and references cited therein). Reporter gene test systems are well known and established for applications in both pro- and eukaryotic cells, using enzymes such as Ji-galactosidase, green fluorescent protein, and several others.

The determination of activity of membrane-transport proteins can be performed according to techniques such as those described in Gennis, R. B., 1989, Pores, Channels and Transporters, in Bliomembranes, Molecular Structure and Function, pp. 85-137, 199-234 and 270-322, Springer: Heidelberg.

Example 16

Purification of the Desired Product from Transformed Organisms

Recovery of the desired product from plant material, fungi, algae, ciliates, *C. glutamicum* cells, or other bacterial cells transformed with the nucleic acid sequences described herein, or the supernatant of the above-described cultures can be performed by various methods well known in the art. If the desired product is not secreted from the cells, the cells can be harvested from the culture by low-speed centrifugation, and the cells can be lysed by standard techniques, such as mechanical force or sonification. Organs of plants can be separated mechanically from other tissue or organs. Following homogenization, cellular debris is removed by centrifugation, and the supernatant fraction containing the soluble proteins is retained for further purification of the desired compound. If the product is secreted from desired cells, then the cells are removed from the culture by low-speed centrifugation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One skilled in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There is a wide array of purification methods known to the art and the preceding method of purification is not meant to be limiting. Such purification techniques are described, for example, in Bailey, J. E. & Ollis, 1986, D. F. Biochemical Engineering Fundamentals, McGraw-Hill: New York. Additionally, the identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek et al., 1994, Appl. Environ. Microbiol. 60:133-140; Malakhova et al., 1996, Biotekhnologiya 11:27-32; and Schmidt et al., 1998, Bioprocess Engineer. 19:67-70; Ulmann's Encyclopedia of Industrial Chemistry, 1996, vol. A27, VCH: Weinheim, p. 89-90, p. 521-540, p. 540-547, p. 559-566, 575-581, and p. 581-587; Michal, G., 1999, Biochemical Pathways: An Atlas of Biochemistry and Molecular Biology, John Wiley and Sons; Fallon, A. et al., 1987, Applications of HPLC in Biochemistry in: Laboratory Techniques in Biochemistry and Molecular Biology, vol. 17.

Example 17

Salt Tolerance Screening
Salt Test on MS Plate

Seedlings are transferred to filter paper soaked in ½ MS and placed on ½ MS 0.6% agar supplemented with 2 ug/ml benomyl the night before the stress screening. For the stress screening, the filter paper with the seedlings is moved to stacks of sterile filter paper, soaked in 50 mM NaCl, in a petri dish. After two hours, the filter paper with the seedlings is moved to stacks of sterile filter paper, soaked with 200 mM NaCl, in a petri dish. After two hours, the filter paper with the seedlings is moved to stacks of sterile filter paper, soaked in 600 mM NaCl, in a petri dish. After 10 hours, the seedlings are moved to petri dishes containing ½ MS 0.6% agar supplemented with 2 ug/ml benomyl. The seedlings are scored after 5 days, demonstrating that transgene expression confers salt tolerance Soil Test for Salt Tolerence Seeds of plants to be tested are sterilized (100% bleach, 0.1% TritonX for five minutes two times and rinsed five times with ddH$_2$O). Seeds are plated on non-selection media (½ MS, 0.6% phytagar, 0.5 g/L MES, 1% sucrose, 2 µg/ml benamyl).

Seeds are allowed to germinate for approximately ten days. At the 4-5 leaf stage, transgenic plants are potted into 5.5 cm diameter pots filled with loosely packed soil (Metromix 360, Scotts) wetted with 1 g/L 20-20-20 fertilizer (Peters Professional, Scotts).

The plants are allowed to grow (22° C., continuous light) for approximately seven days, watering as needed. When the plants are just about to bolt, the water is removed from the tray and the assay is started. To begin the assay, three liters of 100 mM NaCl and ⅛ MS is added to the tray under the pots. To the tray containing the control plants, three liters of ⅛ MS is added. After 10 days, the NaCl treated and the control plants are given water. Ten days later, the plants are photographed.

Example 18

Drought Tolerance Screening

T1 and T2 seedlings are transferred to dry, sterile filter paper in a petri dish and allowed to desiccate for two hours at 80% RH (relative humidity) in a Sanyo Growth Cabinet MLR-350H, micromols$^{-1m2}$(white light; Philips TL 65W/25 fluorescent tube). The RH is then decreased to 60% and the seedlings are desiccated further for eight hours. Seedlings are then removed and placed on ½ MS 0.6% agar plates supplemented with 2 µg/ml benomyl and scored after five days.

The transgenic plants are screened for their improved drought tolerance demonstrating that transgene expression confers drought tolerance.

Example 19

Freezing Tolerance Screening

Seedlings are moved to petri dishes containing MS 0.6% agar supplemented with 2% sucrose and 2 µg/ml benomyl. After four days, the seedlings are incubated at +4° C. for 1 hour and then covered with shaved ice. The seedlings are then placed in an Environmental Specialist ES2000 Environmental Chamber and Incubated for 3.5 hours beginning at −1.0° C. decreasing −1° C. hour. The seedlings are then incubated at −5.0° C. for 24 hours and then allowed to thaw at +5° C. for 12 hours. The water is poured off and the seedlings are scored after 5 days.

The transgenic plants are screened for their improved cold tolerance demonstrating that transgene expression confers cold tolerance.

SEQUENCE LISTING (162 sequences)

SEQ ID NO: 1 - DNA, 1416 bp, Arabidopsis thaliana
  CDS (1)..(1416)
atggaaccagtctcttcatggggtaacacctctctcgtctccgtagatccagagatccacgacctaatcgagaaggagaaacgtcggcaatgtcgaggaatcgaacttatcgcttccgagaatttcacttccttcgccgtcatcgaagctctcggaagtgccttaaccaacaaatactccgaaggtattcccggtaatcgttattacggaggtaacgaattcatcgatgagatcgagaatctttgccgttcaagagctctcgaagctttccattgtgatccagcagcgtggggcgttaatgttcagccgtattctggatctccggcaaatttcgctgcttacacggctttgcttcagcctcacgatcgtatcatggggcttgatttgccttcaggtggtcatttgactcatggttactatacatctggtggtaagaagatctctgcgacttcgatctactttgggagtcttccgtataaggtgaatttcaccactggttacattgattacgataagcttgaagagaaggcgttggatttcaggcctaagttgcttatctgtggtggtagtgcgtatcctagggattgggattacgctagatttagagctattgctgataaggttggagctcttttgctttgtgacatggctcacatcagtggtctcgttgctgctcaggaagctgcaaacccatttgagtactgtgacgttgtgacaaccacaacccacaagagtttgaggggtccaagggctggtatgattttctacaggaagggtccaaaaccaccaaagaagggtcaacccgagggtgcagtctatgattttgaggacaaaatcaactttgctgtattccctgcgcttcaaggtggtcctcacaatcaccagattggtgctctagctgttgcgttgaagcaggctaatactcctgggttcaaggtctacgcaaaacaagtgaaagccaatgctgttgcccttggaaactacctaatgagcaagggttaccagattgtgaccaatggaactgagaaccaccttgttctctgggatcttcgccctcttggattgaccggaaacaaggttgagaagctctgcgatctgtgcagcattacattgaacaagaacgcagtatttggagacagtagtgctcttgctcctggaggtgtaagaatcggtgcacccgcgatgacatcgagaggattggtggagaaggactttgagcagataggagaattcctgagccgtgcagtgacactgacgttggacatccaaaagacatacggtaagttgttgaaggacttcaacaagggtttggtgaacaacaaagatctcgatcagctcaaggctgatgtcgagaagttctcggcgtcttatgagatgcctggattcctcatgtctgagatgaagtaccaggattag

SEQ ID NO: 2 - protein, 471 aa, Arabidopsis thaliana
MEPVSSWGNTSLVSVDPEIHDLIEKEKRRQCRGIELIASENFTSFAVIEALGSALTNKYSEGIPGNRYYGGNEFIDEIENLCRSRALEAFHCDPAAWGVNVQPYSGSPANFAAYTALLQPHDRIMGLDLPSGGHLTHGYYTSGGKKISATSIYFGSLPYKVNFTTGYIDYDKLEEKALDFRPKLLICGGSAYPRDWDYARFRAIADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALGNYLMSKGYQIVTNGTENHLVLWDLRPLGLTGNKVEKLCDLCSITLNKNAVFGDSSALAPGGVRIGAPAMTSRGLVEKDFEQIGEFLSRAVTLTLDIQKTYGKLLKDFNKGLVNNKDLDQLKADVEKFSASYEMPGFLMSEMKYQD

SEQ ID NO: 3 - DNA, 1944 bp, Arabidopsis thaliana
  CDS (531)..(1766)
ctcactagtcccccccccccccggagctttttttgttgtgatatatcccgtaaaaccctaaacatagtcacttcatcgtctcctccactgtatcattcaatctctgtcttccttctttttagcgacctcgtctccaaagctcacaaattttctacctttccggagtagagagaaagatgcaagcttgttgtggtggtaattcgatggcttctcttcagcaacctggacgggttcaaggatctgtctttcccccaattatgcctccagtgaccaaattttctcagcagttgaagttcaatatttcaaaacctttccgttcttcatttctgaaaagaaacctggtctctgaaatgagagcatcttcagtctcgctacctaatgtcgagataagcagcaaagaaatcccttttgaggactatggtcttggtgaagttgatccagaggtccgaaccatcatcacaaaggagaaagatagacaattcaggagcttggagcttattgcatctgagaatttcacgtctcgagcagttatggaggcggttggctcatgccttaccaacaagtattctgagggactgcctggtaaaagatattatggtggcaatgagtacattgatcagttggagacgctttgccagaaccgggctttggcagccttccgcttagattctacgaaatggggggttaatgttcagccgttatctggttcacctgcaaactttgctgtctacactgcgatacttagccctcatgatcggatcatgggtttggatttacctcacggtggtcatctgtcgcatgggttcatgaccgctaaaaggcgtgtatctggaacttcaatatactttgagtccatgccttatcgacttgatgaatcaacaggcattgttgactacgatatgctcgagaaaactgctacacttttcagaccaaagcttattatcgcaggagctagtgcatacagccgagattttgactatcctcgcatgaggaagatcgcagactcagttggtgcttttctgatgatggatatggctcatatcagtgggcttgtggctgcttctgtggtagctgacccttttgagtattgtgatattgttacaacaacaactcacaagtctttgagaggtccgagaggtggcatgatcttcttcaggaaggatccaattaatggggttgatcttgaatctgccgtgaacaatgctgtcttccctggtttgcagggtggccctcataaccacacaattggaggattagcagtctgcttgaaacacgcacaatcaccggaattcaaggcgtaccagaaaagagttgtgtctaactgtagagctctagctaaccgattggttgaactcgggtttaagctagtttctggtggcagcgataaccacttggttctcgtcgatcttagacccatgggtatggatggtgcgcgggttgagaaaatcttagacatggcatctattactctcaacaagaactctgtccctggggacaaaagtgcgttggtaccagggggaataaggataggatcccccgcgatgacgacaagaggactgtcagagaaagactttgtagtagtggctgacttcatcaaggaaggtgtggagataacaatggaagccaagaaagccgcgccgggttcaaagcttcaagatttcaacaagttcgtgacatctcctgagtttccattgaaagagagagtgaagagtctaaaggagagagtggaaaccttcacatctcgttttcccattcctggcgtttaagctataaacacacacagatatgctcttgttgtaccttaattattcacctttttcatctgtcttttagggtttttacttgcttgtgtcccaagtttaaagttacagttgaatcgagagaaattattttcaaaaataaatttatttgtggaacaatgattcgtctatgttcccaaatctc

SEQ ID NO: 4 - protein, 411 aa, Arabidopsis thaliana
MEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 5 - DNA, 1944 bp, Arabidopsis thaliana; identical to SEQ ID NO: 3
  CDS (762)..(1766)

SEQ ID NO: 6 - protein, 334 aa, Arabidopsis thaliana
MGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 7 - DNA, 2144 bp, Zea mays
  CDS (220)..(1755)
cattgggacctcgagccggcggggactggtctccatagtgtaccaaacccacgaggccacaagcacgggactggcatatattatccatgtaaataaaataaagtatataaataaccccataaaaagctaggacgggactacctcccaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggctttccgtttggacccggcgaaatggggagtgaatgtgcaacctctatccggttcgcccgccaacttccatgtatacactgcactcttgaagccacatgaaaggatcatggctttggatcttcctcacggtggacatctttctcatggttaccagactgacactaagaagatatctgcaacttcaatattttttgagacaatgccttacagattggatgaaagcactggattgattgattacgatcagttggagaaaagcgctgttctttttaggccaaagttgatcattgctggtgcaagtgcatatgctcggctatatgattatgaccgtatgcggaagatatgcaacaagcagaaggcaatacttctagcagacatggcacatattagtgggcttgttgcagctggtgttgttccatctccttttgattatgcagatgtagtgactaccactactcacaaatcactccgtgggccacgtggagccatgatcttttacaggaagggagtcaaagaaataaataaacaaggaaaagaggttatgtatgattttgaggacaaaatcaatgctgctgtctttcctggtctgcaaggtgggcctcataaccataccattactggcttggctgttgcgctcaaacaggcaactactccagaatacagagcttaccaagagcaagttatcagtaattgtgctaaatttgcgcagagcctgatttcaaaaggatatgaactcgtctctggtgggactgacaaccatttagttctggtgaatctcaagaataaggggatagatggttcaagggtggagaaggttttagaaagtgtgcatattgcagcaaacaagaacacagttcctggtgatgtttcagctatggtgccaggaggcatcaggatgggaaccccagcccttacgtcgagaggatttgttgaagaagatttcgctaaagttgctgacttcttcgatgcagcagtgaatctggccttgaagattaaggctgcaacgacaggtggaacaaagctgaaggactttgttgccactttgcaatctgatagcatccaagttgagattgcaaagcttcgccatgatgtagaggaatttgcaaaacaattcccaacaattggatttgagaaagagaccatgaaatacaagaactaatatctggatgacaagaagagaatgaggtcactcttcttgcagtaagcattcgaagcaagatgccacgatgattattgggagtttaaccatggtgtaatggcatcttatgttaaagagatgttggcaatttacagcatgtggaactttcgtcaatcatattgtagacacataccgcgagatgctatattgaccggacaattgcatttccatatgtgtaaaaaaaaagcgttcaaaaaaaaaacgtacatcctgacacacactccacccccatccccactcacaagcacacgtcaccctgcccgcaaggctatctactcatctctataatcaaactatactatgtgaaagttatagtctacggtgcaaaatagtgcaaaatagtgttttag

SEQ ID NO: 8 - protein, 511 aa, Zea mays
MATALRKLSANALRRQPLSRITPLYYMASLPATEERSGITWTKQLNAPLEEVDPEIADIIEHEKARQWKGLELIPSENFTSVSVMQAVGSVMTNKYSEGYPGARYYGGNEFIDMAESLCQKRALEAFRLDPAKWGVNVQPLSGSPANFHVYTALLKPHERIMALDLPHGGHLSHGYQTDTKKISATSIFFETMPYRLDESTGLIDYDQLEKSAVLFRPKLIIAGASAYARLYDYDRMRKICNKQKAILLADMAHISGLVAAGVVPSPFDYADVVTTTTHKSLRGPRGAMIFYRKGVKEINKQGKEVMYDFEDKINAAVFPGLQGGPHNHTITGLAVALKQATTPEYRAYQEQVISNCAKFAQSLISKGYELVSGGTDNHLVLVNLKNKGIDGSRVEKVLESVHIAANKNTVPGDVSAMVPGGIRMGTPALTSRGFVEEDFAKVADFFDAAVNLALKIKAATTGGTKLKDFVATLQSDSIQVEIAKLRHDVEEFAKQFPTIGFEKETMKYKN

SEQ ID NO: 9 - DNA, 1875 bp, Zea mays
  CDS (206)..(1621)
caccaacaacaccaccagtccaccaccacccacctcccacatgtgcacacgcgcccacctcccgtccaccaccgctatatatcccggcgccccttcctccctcccccgtccttccctccgcctccgcctccgcccccgcccccgcccacgcccactcctcgctgccaccactcctgtcacctcttcccgcgccgacgcagccgccatggaccccgtcgccacatgggggctaaccccgctcgcgggcgccgacccggagatctacgacctcctggagcgcgagaagcggcgccagcgtcgcggcatcgagctcatcgcctccgagaacttcacctccttcgccgtcatggaggcgctcggctccgcgctcactaacaagtactccgagggcatgcccggtgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtagatatgcctctttcatgcgcggcaaggtcctcctgtaccgatgtctttccttgtggtggcgcagggtgccatggcactgcattgccgccacacttacgatgatgatgatgggttatggattttgtctacaatgtcagcaggataggctcacaattgccccctgccctccggtttggtcgcctctcaggttttcatttggtagttgttcgcagggaaccatatgagaattgcaatgtcaatcaggtgtttgccaat

SEQ ID NO: 10 - protein, 471 aa, Zea mays
MDPVATWGLTPLAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 11 - DNA, 1875 bp, Zea mays; identical to SEQ ID NO: 9
  CDS (347)..(1621)

SEQ ID NO: 12 - protein, 424 aa, Zea mays
MEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 13 - DNA, 1944 bp, Arabidopsis thaliana; identical to SEQ ID NO: 3
  CDS (204)..(1766)

SEQ ID NO: 14 - protein, 520 aa, Arabidopsis thaliana
MASLQQPGRVQGSVFPPIMPPVTKFSQQLKFNISKPFRSSFLKRNLVSEMRASSVSLPNVEISSKEIPFEDYGLGEVDPEVRTIITKEKDRQFRSLELIASENFTSRAVMEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 15 - DNA, 1944 bp, Arabidopsis thaliana; identical to SEQ ID NO: 3
  CDS (258)..(1766)

SEQ ID NO: 16 - protein, 502 aa, Arabidopsis thaliana
MPPVTKFSQQLKFNISKPFRSSFLKRNLVSEMRASSVSLPNVEISSKEIPFEDYGLGEVDPEVRTIITKEKDRQFRSLELIASENFTSRAVMEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 17 - DNA, 2073 bp, Glycine max
  CDS (187)..(1770)
cccacgcgtccgcccacgcgtccgctcaactttgaaattcttaaaaccctaactggtccgaaccattggagccaccgtgcaatagttcctcctctcactctctccctcaacacaccattgattttggtttcagctttatttggaagagggttgtaacgctgacgtgaaatttttctgaagacaaagatgcaggcttgtacaacgatgagttctttgcagcaacaacctatttggaccaaagggttaaatttccctgcaaaagggtatggcagcaataacgggtttctacctcaggtgaggttctgcaatattaagccatccaaagcttctcatgttgaagcaagtttagtcactgggaagccgtcatctgtgcctttctctgtgcctgaaattggaggcgacggaagtagcttcctggactatggcttgagtgaagctgatcctgatgttcgtgcaattattgacaaggaaaaggaccgacaatttaaaagtcttgagcttattgcttctgagaattttacatctagagcagtgatggaagcagttgggtcgtgcctcacaaacaagtactcagaaggattgccgggtaaaaggtactatggtggcaatgagtacattgatgagcttgaaatcctatgtcaacaaagggcactggctgcatttcatgtagatgaaaacaaatggggtgttaatgttcaaactttatctggttcccctgctaattttgcagtatacactgcagttcttaaaccacatgatcggataatgggtttggacttgcctcacggaggacatttgtctcatggattcatgacacccaaaaaacgtgtatcagccacatcaatttattttgaatctatgccttatcgacttgatgaatcaacaggtcttattgattatgatatgctggagaaaactgctactctgtttcgtccaaaactcattgttgctggtgctagtgcttatcctcgggacattgactaccctcgtatgagaaaaattgcagatgaagtaggtgcttttcttatgatggatatggctcatataagtgggcttgttgctgcatctgtactttctaatccctttgagtattgtgatattgtgaccaccacaacccacaagtctttacgaggtccaagaggtggtatgatattcttcaagaaagatactgtgcatggggttgatttggagcctgccattaacaatgctgtttttcctggtctacaggggggtcctcataaccacacaattggaggactagcagtttgcttgaagtatgctcagtctccagaatttaaaaattatcaaaatcaggtggttgctaactgtagagctcttgctaagcgattaattgagcatggatataaactggtttctggtggtagtgacaatcacctggttcttgtcgatctaaggccatctggtcttgatggtgctcgggtggagaaaattcttgacttggcttctataaccctcaacaaaaattcagtgcctggtgataagagtgccctagttccaggaggcattcgcattggggcaccagcaatgacaacaagaggacttggtgagaaagaattttcactcattgctgatttcattcatgagggtgtgcaaataagtcttgaagccaaaagtttggtctcaggaacgaagctccaagattttttgaagtttgtaacatcttctgaatttcctttgggagagaaggtatcagagttgcgtaggaaagttgaagctcttactactcagtatccaatacccggagtctaagtgtacccgcataatgaatacttaaaactaagacgctgttaaaaaattttgtacaataatcatgcttcgatgtgtgttgctaataatatgttgtaacattttatggcaaatgcagcagcagctttatgattatcccatttataattggaagcaaaccaatccaatccttgatccttcaaatattccttagtaattaatattgtagatgaatggaaagcaaattggtaacgagtggcccgacttcttggggttcgaaaagctttgtacttgaattgaaagaccacttcaagacttaggtccttt

SEQ ID NO: 18 - protein, 527 aa, Glycine max
MQACTTMSSLQQQPIWTKGLNFPAKGYGSNNGFLPQVRFCNIKPSKASHVEASLVTGKPSSVPFSVPEIGGDGSSFLDYGLSEADPDVRAIIDKEKDRQFKSLELIASENFTSRAVMEAVGSCLTNKYSEGLPGKRYYGGNEYIDELEILCQQRALAAFHVDENKWGVNVQTLSGSPANFAVYTAVLKPHDRIMGLDLPHGGHLSHGFMTPKKRVSATSIYFESMPYRLDESTGLIDYDMLEKTATLFRPKLIVAGASAYPRDIDYPRMRKIADEVGAFLMMDMAHISGLVAASVLSNPFEYCDIVTTTTHKSLRGPRGGMIFFKKDTVHGVDLEPAINNAVFPGLQGGPHNHTIGGLAVCLKYAQSPEFKNYQNQVVANCRALAKRLIEHGYKLVSGGSDNHLVLVDLRPSGLDGARVEKILDLASITLNKNSVPGDKSALVPGGIRIGAPAMTTRGLGEKEFSLIADFIHEGVQISLEAKSLVSGTKLQDFLKFVTSSEFPLGEKVSELRRKVEALTTQYPIPGV

SEQ ID NO: 19 - DNA, 2055 bp, Glycine max
  CDS (75)..(1631)
cggctcgagcgggacttcttcttcaaaaacacacaagcacactacactttgtctctgttctgtgtgtgcgagaaatggcgatggcaatggcgcttcgcaggctttcatcttcaattgacaagcctctgcgccctctcttcaatgccggttccctctactacaagtcgtctttgcctgatgaagctgtttacgacaaggagcgacccggagttacatggccgaagcagttgaatgctccacttgaggtcgtggatcctgagattgctgatattattgagcttgagaaagctaggcaatggaaggggctagaattgataccgtcagagaatttcacctctgtgtctgtgatgcaagcggttggatcggttatgaccaacaaatacagtgaggggtaccctggtgcaagatattatggtggaaatgagtatattgacatggctgaaacactgtgccaaaagcgtgccctagaagcttttagattggatcccgctaaatggggagtgaacgtgcagcctctgtcagggtctcctgcaaatttccacgtttacactgcattgcttaaacctcatgaaagaatcatggcacttgatcttcctcatggtggccatctttctcacggatatcagactgataccaaaaagatatctgcagtctcgatattttttgagacaatgccatatcgattgaatgaaagtacaggatacatcgactatgaccagatggagaaatctgctacactcttcaggccaaaattaattgttgctggagctagcgcttatgcacgtctctatgattatgaacgtgtacgcaaggtttgcgataaacagaaagctatactattggcagatatggcacacatcagtggattggttgcagctggtgtcatcccatcaccttttgattatgctgatgtagttactaccacaactcacaagtcacttcgaggaccacgtggagctatgatattctacagaaaaggggttaaagaaattaacaaacaaggaaaagaggtattgtatgactacgaagacaaaatcaaccaagctgttttccctggactgcaaggtggccctcacaaccacactattactggtttagctgttgcgttgaagcaggccactactcccgaatatagagcatatcaagagcaagttctcagcaacagctttaaatttgcacaggctctgagtgagagaagctatgagcttgtctctggtggaaccgagaatcacctggttttggtgaatctgaagaataagggtattgatggctccagagttgagaaggtgttggaagcagttcatattgcagctaataaaaacactgttcctggagatgtgtctgccatggttcctggtggcatcaggatgggaacccctgctcttacttctagaggatttgttgaggaggattttgtcaaggtagcagagttttttgatgcagcagtgaagatagctgtgaagattaagggagagagcaaaggaacaaagctgaaggacttcttggccacaattgagtcatcttctacctttcaatcggagatagcaaagctccgccttgatgttgaggagtatgcaaaacaatttccaaccattggttttgataaagcaaccatgaagcacaagaattgagaaaagaaaattttccattaggtcatcccatggtcttactggcaagcaattcaacaagatcagttttcctgatccatggtagaggacgacaacatattttaaaaacaatgtcaaaagcctttatatgtaagaatccagaaaatcttgatcgttatgttgaaatgtatagatgcatatgtaataaaggcttcaaataccaaatttcttaatcagatgattgttgaacctatcccctataatggggttacaatcgatcgtaagtggttgtatctgctataaattcaactagcctcctcaattgcatagaatcctgctggatgctgatgtgaattattttacctcaatgatatttcttaaataaaaatttcatttgccttaaaaaaaaaaaactgaattcctttatttatcctaattccccggatcc

SEQ ID NO: 20 - protein, 518 aa, Glycine max
MAMAMALRRLSSSIDKPLRPLFNAGSLYYKSSLPDEAVYDKERPGVTWPKQLNAPLEVVDPEIADIIELEKARQWKGLELIPSENFTSVSVMQAVGSVMTNKYSEGYPGARYYGGNEYIDMAETLCQKRALEAFRLDPAKWGVNVQPLSGSPANFHVYTALLKPHERIMALDLPHGGHLSHGYQTDTKKISAVSIFFETMPYRLNESTGYIDYDQMEKSATLFRPKLIVAGASAYARLYDYERVRKVCDKQKAILLADMAHISGLVAAGVIPSPFDYADVVTTTTHKSLRGPRGAMIFYRKGVKEINKQGKEVLYDYEDKINQAVFPGLQGGPHNHTITGLAVALKQATTPEYRAYQEQVLSNSFKFAQALSERSYELVSGGTENHLVLVNLKNKGIDGSRVEKVLEAVHIAANKNTVPGDVSAMVPGGIRMGTPALTSRGFVEEDFVKVAEFFDAAVKIAVKIKGESKGTKLKDFLATIESSSTFQSEIAKLRLDVEEYAKQFPTIGFDKATMKHKN

SEQ ID NO: 21 - DNA, 1795 bp, Glycine max
  CDS (73)..(1296)
caacaacactctctcttctcgctcttggcttttcgctcttcactcactctcattcattcatttccaccgttcatggatccagtaagcgtgtggggtaacacgcccttggcgacggtggatcccgagatccatgacctcatcgagaaggagaagcgccgtcaatgccgcggaatcgagctcatcgcctccgagaacttcacctccttcgccgtcatcgaggccctcggcagcgctctcacgaacaaatactccgagggcatgccgggcaaccgctactacggcggcaatgaatacatcgaccagatcgaaaacctctgccgctcacgcgccctccaagccttccacctcgacgcccaatcctggggcgtcaacgtccagccctactccggctccccggccaacttcgccgcctacaccgccgtcctcaacccccacgaccgcatcatggggctagatctcccctccggcggccacctcacccacggctactacacctccggcggaaagaagatctccgccacctccatttacttcgagagtctcccttacaaggtaaactccaccaccggctacatcgactacgaccgcttggaagaaaaagccctagacttcaggccaaaactcataatctgcggtggcagcgcgtaccctcgcgattgggactacaaacgtttcagggaagtcgctgataagtgcggagcattgcttctctgcgacatggcgcacactagcggccttgtggccgcgcaggaagtgaacagccccttcgagtattgcgacattgtgaccaccacgactcacaagagcttgcggggcccacgtgcggggatgatcttttaccggaagggccccaagccgccgaagaaggggcagccggagaacgcggtttatgatttcgaggacaagattaacttcgcggtgttcccttcgctgcagggtgggccccacaaccaccagatcggtgctctcgccgtggcgctgaagcaggccgcgtcgcccgggtttaaggcctacgcgaagcaggttaaggcgaacgccgttgcgcttggaaaatacttgatggggaaagggtacagccttgtcactggcggaacggagaaccatcttgttttgtgggatctgagacctcttggattgactgggaataaggtggagaaactctgtgatctctgtaacattactgttaacaagaacgctgtttttggtgatagcagtgccttggcccctggtggagtgcgaattggtaacgatcttacttctcttttatatgctacaatacaaatcttgctttactaactcaattggaaacaagatctcatttataagattataaaaatgatttccttaggctaggactatatcctctctctctctctctctttttcttttttatcatcgcagaacttagatgaattttcttacgtaattttagtactgttctcttatcagagttcgaaagtaagttataaaatttctattgaaggcttgcatatttatataagtgaaattttaattttggttggagaacaatgtccaaaacaccaaagtgattgcatctaagttttttggattttttaatgtatttgtattttgtacaaggtatcttagtaagttgttgtagattagtattgaaagagatttcattgaggatgtgttttttagtgctttaacaaaggaggtatgttagttcgggctaaagcttgcagactgcctttgttaaagaatttcgagttgttgtcgtgcaatatgattggcaaatcaattataaactaatctgttattttgtttttctgat

SEQ ID NO: 22 - protein, 407 aa, Glycine max
MDPVSVWGNTPLATVDPEIHDLIEKEKRRQCRGIELIASENFTSFAVIEALGSALTNKYSEGMPGNRYYGGNEYIDQIENLCRSRALQAFHLDAQSWGVNVQPYSGSPANFAAYTAVLNPHDRIMGLDLPSGGHLTHGYYTSGGKKISATSIYFESLPYKVNSTTGYIDYDRLEEKALDFRPKLIICGGSAYPRDWDYKRFREVADKCGALLLCDMAHTSGLVAAQEVNSPFEYCDIVTTTTHKSLRGPRAGMIFYRKGPKPPKKGQPENAVYDFEDKINFAVFPSLQGGPHNHQIGALAVALKQAASPGFKAYAKQVKANAVALGKYLMGKGYSLVTGGTENHLVLWDLRPLGLTGNKVEKLCDLCNITVNKNAVFGDSSALAPGGVRIGNDLTSLLYATIQILLY

SEQ ID NO: 23 - DNA, 1275 bp, Oryza sativa
  CDS (1)..(1275)
atggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggcaacaaggttgagaagatgtgtgacctttgcagcattacacttaacaagaatgctgtctttggtgacagcagtgcattggctcctggcggtgtccgcattggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtag

SEQ ID NO: 24 - protein, 424 aa, Oryza sativa
MDSVASWGLTPLAAADPLVHDLLEREKRRQRSGIELIASENFTSFAVMEALGSALTNKYSEGMPGARYYGGNDVIDEIENLCRDRALAAFRLDAASWGKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGKYLMSKGYKMVTDGTENHLVLWDLRPLGLTGNKVEKMCDLCSITLNKNAVFGDSSALAPGGVRIGTPAMTSRGLVEKDFEQIGEFLHQAVTICLNIQKEHGKLLKDFSKGLVNNKDIENLKLEVEKFATSFDMPGFTLDSMKYKE

SEQ ID NO: 25 - DNA, 1876 bp, Oryza sativa
  CDS (70)..(1485)
gcgttctctcgccgccgcaaccaccgccgcctcgccgcagcatcacgggcagccgccgccgccgccgccatggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcaacgtgcagccctactccggctcgccggccaacttcgccgcctacacggcgctcctcaacccgcacgaccgcatcatggggctcgacctcccctccggtggccacctcacccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggcaacaaggttgagaagatgtgtgacctttgcagcattacacttaacaagaatgctgtctttggtgacagcagtgcattggctcctggcggtgtccgcattggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtaggaaaacaaaaacacacacaaaccatggtcctaccgccgctaatcgtcgaccagctgtgctctcgtggaccgccgtcgtcgtcatcttcttcctcggcacaagctggccctgtgttacggattttgtctgcccatcgagatgataggtttcataaaacgctctctcccccaccctgctgctgcctctggtttggttgccaacctcatcccccatcggtttttttcctcctcttgtttctaatttctaggagctgtgccttttggaatcatggaatgtcaagtatttgccaataatcaatccgtttgatttctgcctaccttgtgttttctgtgggattgctaaactatcaaactgtgcgaagctacgaaaaaaagaaatgctggaatttttc

SEQ ID NO: 26 - protein, 471 aa, Oryza sativa
MDSVASWGLTPLAAADPLVHDLLEREKRRQRSGIELIASENFTSFAVMEALGSALTNKYSEGMPGARYYGGNDVIDEIENLCRDRALAAFRLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGKYLMSKGYKMVTDGTENHLVLWDLRPLGLTGNKVEKMCDLCSITLNKNAVFGDSSALAPGGVRIGTPAMTSRGLVEKDFEQIGEFLHQAVTICLNIQKEHGKLLKDFSKGLVNNKDIENLKLEVEKFATSFDMPGFTLDSMKYKE

SEQ ID NO: 27 - DNA, 2422 bp, Oryza sativa
  CDS (314)..(2116)
  misc_feature (2368)..(2368): n is a, c, g, or t
accacacatccccccccccccttcccctcctcaccttcccttctccggttctcagattccacccaatccgccgctgcgtcgcgtgtgctgttcggcgaaattccaagccccaattccccacatctcatggttctctctcccatcgcctccgccgacgtcgaccgcctcctttgctgctgtcgccggtgttgttgctgtcgccggtgttgttgttgttgagggggtaacggtggtggtggtggtggtggtgaggggttagaggggctagggttgcggatttgcggccaattggttgggggatttcgaagggggaatggatctctcgcggccggaatcgtcggacctgtcgctgggtttccactcgctcggccacgcccgcgggcacgcggtcacggggccgctgcggctgttcgatgacatggaggacgccaagccggagaagagcgtcggtggcggcggaggaggagggggaggaggaggcgaggaggaggatggggaggaagggggcgaccagcacttctccctcctcggccacgcgctctgcgtcaagcgtccacgccgcgcgctctacggaggcggaggcggaggcggggcaggaggtggaggaggaggaggaggggaggcgtcctcctgctcgtcttcctcctcgtcgctgcacccggcgaagcggcaggcgacggcggagcgcggcgcggatctggaggcccgccgcggcgccgtccgcgcgtggggcaaccaggcgctggcggaggccgacccggacgtgcacgcgctgatggagctcgagcgcgaccgccaggtgcgcgggatcgagctgatcgcgtcggagaacttcgtctgccgcgcggtgctcgaggcgctcggcagccacctcaccaacaagtactctgagggccatcccggggctcggtactatggcgggaaccagcacatcgacggcatcgagcgcctctgccatgagcgcgccctcgccgccttcggtctcgaccccgcctgctggggggtcaacgtccagccatactcctgcacctctgcaaacctagctgtttacacaggtctcctcctgcccaaggaccgtatcatggggctcgagccgccttccggtggccatgtcagccacgggtactacacaccaagtggtaagaaggtgtctggagcatccatattcttcgagagcttgtcgtacaaggtgaatccgcagactgggtatattgattacgacaagcttgaggagcgggcaatggatttccaccctaagattctcatatgtggtgggagctcataccccagggagtgggattttgcacggatgaggctcattgctgataagtgcggtgcggtgctcatgtgcgatatggcacatatcagcgggcttgttgcggccaaggaatgccgtagtccctttgattactgtgatgtggttacatcaactactcacaagaatctgagaggtcctagaggtggtataatatttttcaggagagggaaaaacttaaggaggcgtactggatctttttctcaagcggatgagaatgattatgacttcgaggacaggataaattttgcagttccacgctcaaggcaaggaggaccccataataatcatattgcagccttggcgataactctgaagcaagtagcaacacctgaatacaaagcatacatcatacaagttaagaaaaatgcccaagctttggcatcagccttactcagaagaaaatgcagattggttactggtggcaccgataaccacttggtactttgggacctcagaaatttaggcttgactggaaagaactttgagaaggtctgtgaggcatgccacatctccataaataagatgccgatatatggggataatggctcaatatctcctgggggtgttcggattggaacacctgcaatgactactagaggttgcttggaagatgactttgaggtgatcgcagatttcctcatcagagccacccaaatagctagtaatcttatgaaagaacatggaaaaatgcagaaggaattcctgagaggcctacagaacaataaagatatcatagaactccgtaaccaggttgagaattttgcatcgcagtttgcaatgccaggttttgatgtatgagtgtgcatgtatgtgtacatatcttggtgaggttgtccagattcatcaggaattagcaaccgtttcactctttgccgaagtgtttctttcaacaggagcagaatagggaaagatcgttttttcttttgttggaaattggtcttgactgaagctgtacatgcatacttctgagttgtcatttatgtaacgtattgaaccttcatataacggctttgtataggagataattttcctccatgcgtaaggatcttnaaaaaaaaaaaaaaaaaaaaaaaaaaaaaaaaaaaaaaaaaaaaaaaaaaaaaa

SEQ ID NO: 28 - protein, 600 aa, Oryza sativa
MDLSRPESSDLSLGFHSLGHARGHAVTGPLRLFDDMEDAKPEKSVGGGGGGGGGGGEEEDGEEGGDQHFSLLGHALCVKRPRRALYGGGGGGGAGGGGGGGGEASSCSSSSSSLHPAKRQATAERGADLEARRGAVRAWGNQALAEADPDVHALMELERDRQVRGIELIASENFVCRAVLEALGSHLTNKYSEGHPGARYYGGNQHIDGIERLCHERALAAFGLDPACWGVNVQPYSCTSANLAVYTGLLLPKDRIMGLEPPSGGHVSHGYYTPSGKKVSGASIFFESLSYKVNPQTGYIDYDKLEERAMDFHPKILICGGSSYPREWDFARMRLIADKCGAVLMCDMAHISGLVAAKECRSPFDYCDVVTSTTHKNLRGPRGGIIFFRRGKNLRRRTGSFSQADENDYDFEDRINFAVPRSRQGGPHNNHIAALAITLKQVATPEYKAYIIQVKKNAQALASALLRRKCRLVTGGTDNHLVLWDLRNLGLTGKNFEKVCEACHISINKMPIYGDNGSISPGGVRIGTPAMTTRGCLEDDFEVIADFLIRATQIASNLMKEHGKMQKEFLRGLQNNKDIIELRNQVENFASQFAMPGFDV

SEQ ID NO: 29 - DNA, 1944 bp, Oryza sativa
  CDS (99)..(1694)
cccacgcgtccgaggctcccctctccactccccttccctcacccgcgccgcatcgcagccgctatccgcgtgggcattccgccgagcacctggcgcgcatggcgatggcttcgcaccacctcgcccagccgcccacgcgcgcggctctctcctcgcgccccacctacccgctctccagccatcaccactcctcccgtctccagctcccgctcgtcagcggggcgcggcgcagcaggctgtcccccgcggtggcgacgtccccggtcgccgccccagcgatggacgccgtggccgactgggggctgaccactctggaggaggctgacccggaggtgtacgacctcgtcgagcgcgagaagcggcggcagcgcgcgggcgtcgagctcatcgcgtcggagaacttcacctcgctcgccgtcatggaggcgctgggctcgccgctcaccaacaagtactccgagggcatgccggggtcccgctactacggaggcaacgaggtcatcgacgaggtggaggagctctgccgcgcccgcgcgctcgccgccttccacctcgaccccgaggcctggggcgtcaacgtgcagccctactccggctcgccggcgaacttcgccgcctacaccgggctgctccaaccccacgagcggatcatggggctcgatttgccgtccggcggccacctcacgcacggctactacaccgccggcggcaaaaagatctccgccacgtccatctacttcgagagcctgccgtacaaggtgagctccgagacaggatacgtcgattatgataagctggaggagaaggccatggattttcggcccaagctcatcatctgcggcgggagcgcgtacccgcgggattgggattacgccaggttcagggccatcgcggataagtgcggcgccatgttgctctgcgacatggctcacatcagtggcctagttgccgcgcaggaggctgcaaatccttttcaatattctgatgtggttaccaccaccacccacaagagtctccgagggccaagatctggtatgatcttctacaggaagggcctgaagcctcccaagaaaggccagcctgagggcgctctgtatgactacgaggacaggatcaacttcgcagtgtttccgtcgctccaagggggccctcacaaccaccaaattgctgcgctagcggttggtttgaagcagactatgtcacctggattcaagtcttatattaagcaggtcaaggccaatgctgttgcccttggtaaccatttgatgagtaagggctacaaattggttactgacggaacagagaaccatcttgttctctgggatctgcgccctcttggcttgactggtaacaaagttgagaaggtctgtgatttgtgcagcattacactgaacaaaaatgctgtctttggggatagcagtgcaatgtcacctggtggtgtccgcattggtacacctgccatgacatcaaggggtttggtagaggaggactttgtacagatcgccgagttccttcaccaggcagtgaccatctgcttggatgttcagaaggagcgtggcaagcttctcaagtacttcaacgagggcctggagaacaacaaggacattgaggacctcagggcggaggtggagaagtttgccacttcattcgagatgcctggcttcagggtatccgacatgaagtacaaggattaggcggcatcgtgcacatcgtcctctttctcttgccctgaactttggcgcccttgaaacctgattactgtggcgtgaatcgtggtgtatggattttgctgaactctgggtagtctctaaccgctttcgtctacctgagctggttgtgccattcagtcgttaaatgctggaattgtaatgatgtggtataataataataactagcatggtggtccgcgcagattgcgcggctagcatcattatattttctctc

SEQ ID NO: 30 - protein, 531 aa, Oryza sativa
MAMASHHLAQPPTRAALSSRPTYPLSSHHHSSRLQLPLVSGARRSRLSPAVATSPVAAPAMDAVADWGLTTLEEADPEVYDLVEREKRRQRAGVELIASENFTSLAVMEALGSPLTNKYSEGMPGSRYYGGNEVIDEVEELCRARALAAFHLDPEAWGVNVQPYSGSPANFAAYTGLLQPHERIMGLDLPSGGHLTHGYYTAGGKKISATSIYFESLPYKVSSETGYVDYDKLEEKAMDFRPKLIICGGSAYPRDWDYARFRAIADKCGAMLLCDMAHISGLVAAQEAANPFQYSDVVTTTTHKSLRGPRSGMIFYRKGLKPPKKGQPEGALYDYEDRINFAVFPSLQGGPHNHQIAALAVGLKQTMSPGFKSYIKQVKANAVALGNHLMSKGYKLVTDGTENHLVLWDLRPLGLTGNKVEKVCDLCSITLNKNAVFGDSSAMSPGGVRIGTPAMTSRGLVEEDFVQIAEFLHQAVTICLDVQKERGKLLKYFNEGLENNKDIEDLRAEVEKFATSFEMPGFRVSDMKYKD

SEQ ID NO: 31 - DNA, 1750 bp, Sorghum bicolor
  CDS (58)..(1473)
gccccccgccccctcctcgcctccgccagtcctgtcaacccctcccacgccgccgccatggaccccgtcgccacatgggggctaaccccgctcgccggcgccgacccggagatctacgacctcctggagcgcgagaagcggcgccagcgtcgcggcatcgagctcatcgcctccgagaacttcacctccttcgccgtcatggaggcactcggctctccgctcaccaacaagtactctgagggcatgcccggtgcccgctactacggcggcaacgacgtcatcgacgagatcgagaacctctgccggtcacgcgcgctcgctgccttccgcctcgacgccgcgttctggggcgtcaacgtgcagccctactcgggctcccccgccaacttcgccgcttacaccgcgctgctcaacccgcacgaccggatcatggggcttgaccttccctccggcggacacctcactcacggctactatactgccggcgggaagaagatctccgccacctcgatctactttgagagcctgccgtacaaagtgagcgccaccaccgggtacatcgactacgagaaactcgaggagaaggcacttgacttccgccccaagctcatcatctgcggtggcagcgcgtacccgagggactgggactactccaggctcagggccatcgccgacaaggtcggggccctgctgctctgcgacatggcgcacatcagcggactcgtcgccgcggaggaagctgcaaatccttttgaatattgtgatgtggttaccactaccacacacaagtctcttagagggccaagggctggcatgatcttctacaggaaaggccctaagccccccaagaagggccagcctgagggtgctgtgtatgattatgaagacaagatcaactttgctgtgttcccatctctccaaggtggccctcacaaccaccagattgctgcacttgctgttgctctgcagcaaactatgacacctggcttcaaggcctatgcaaagcaagtgaaggccaatgctgttgcaattggaaactatctcatgagcaagggctacaagatggtgactgatggaactgagaaccaccttgttctctgggatctccgccctcttggcttgactggaaacaaggttgaaaaactctgtgacctttgccacatcacattgaacaagaatgctgtctttggtgacagcagtgcattggctccgggtggtgtccgcattggtgcgccagcaatgacctcgaggggtctagtggagaaggactttgagcagattggagagttcctccaccaggcggtgaccatctgcctgaacattcagaaggagtacggcaagctcctcaaggacttcaacaagggcctgttgaacaacaaggacattgagaacctcaagacccaggtggagaagttcgccgactctttcgacatgcctgggttcacgcttgagagcatgaagtacaaggagtagatgtctcccgtgtataacaaggccctcttgtaccaatgtttttcttggccatggcggagggtgccatggcactgcactgccacacttaaggtgatgatggcttatggattttgtctacaacgtcagcagtataggctcacaagtgccccctgccctctggtttggtcgccttcggtttatcaggttttcctttggtacttgttcgcagggagtcatgaaaatgtcaatcaggtgtttgccaataataattccgtggtttcagccagcagcttttttt

SEQ ID NO: 32 - protein, 471 aa, Sorghum bicolor
MDPVATWGLTPLAGADPEIYDLLEREKRRQRRGIELIASENFTSFAVMEALGSPLTNKYSEGMPGARYYGGNDVIDEIENLCRSRALAAFRLDAAFWGVNVQPYSGSPANFAAYTALLNPHDRIMGLDLPSGGHLTHGYYTAGGKKISATSIYFESLPYKVSATTGYIDYEKLEEKALDFRPKLIICGGSAYPRDWDYSRLRAIADKVGALLLCDMAHISGLVAAEEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGNYLMSKGYKMVTDGTENHLVLWDLRPLGLTGNKVEKLCDLCHITLNKNAVFGDSSALAPGGVRIGAPAMTSRGLVEKDFEQIGEFLHQAVTICLNIQKEYGKLLKDFNKGLLNNKDIENLKTQVEKFADSFDMPGFTLESMKYKE

SEQ ID NO: 33 - DNA, 2144 bp, Zea mays; identical to SEQ ID NO: 7
  CDS (214)..(1755)

SEQ ID NO: 34 - protein, 513 aa, Zea mays
MAMATALRKLSANALRRQPLSRITPLYYMASLPATEERSGITWTKQLNAPLEEVDPEIADIIEHEKARQWKGLELIPSENFTSVSVMQAVGSVMTNKYSEGYPGARYYGGNEFIDMAESLCQKRALEAFRLDPAKWGVNVQPLSGSPANFHVYTALLKPHERIMALDLPHGGHLSHGYQTDTKKISATSIFFETMPYRLDESTGLIDYDQLEKSAVLFRPKLIIAGASAYARLYDYDRMRKICNKQKAILLADMAHISGLVAAGVVPSPFDYADVVTTTTHKSLRGPRGAMIFYRKGVKEINKQGKEVMYDFEDKINAAVFPGLQGGPHNHTITGLAVALKQATTPEYRAYQEQVISNCAKFAQSLISKGYELVSGGTDNHLVLVNLKNKGIDGSRVEKVLESVHIAANKNTVPGDVSAMVPGGIRMGTPALTSRGFVEEDFAKVADFFDAAVNLALKIKAATTGGTKLKDFVATLQSDSIQVEIAKLRHDVEEFAKQFPTIGFEKETMKYKN

SEQ ID NO: 35 - DNA, 2136 bp, Zea mays
  CDS (143)..(1705)
aaacccctccgaccacccaatctccgccccccgcattctgtcgaacacctcgtcttcgctcgcaccgaccccaccgcaccgcaccgcaccgcacctcacctccaccaacaacaccaccagtccaccaccacccacctcccacatgtgcacacgcgccctcctcccgtccaccaccgctatatatcccggcgccccttcctccctcccccgtccttccctccgcctccgcccccgcccactcctcgctgccaccactcctgtcacctcttcccgcgccgacgcagccgccatggaccccgtcgccacatgggggctaaccccgctcgcgggcgccgacccggagatctacgacctcctggagcgcgagaagcggcgccagcgtcgcggcatcgagctcatcgcctccgagaacttcacctccttcgccgtcatggaagcgctcggctccgcgctcactaacaagtactccgagggcatgcccggcgcccgctactacggcggcaacgacgtcatcgacgagatcgagaacctctgccggtcacgcgcgctcgctgccttccgccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtagatatgcctctcccatgcgcggcaaggtcctcctgtaccgatgtctttccttgtggtggcgcagggtgccatggcactgcattgccgccacacttacgatgatgatgatgggttatggattttgtctacaatgtcagcaggataggctcacaattgccccctgccctccggtttggtcgcctctcaggttttcatttggtagttgttcgcagggaaccatatgagaattgcaatgtcaatcaggtgtttgccaataataattgggtggtttctgctcttgctctggtcattaccatgcattttttattctgttggtgagttggtcgatttattatctcctgcagtcctgctggcactgccggtggtcgtttgattatcatgtatgaatcttcctggagactgttgctcgattaacatatcgcctgctcctgc

SEQ ID NO: 36 - protein, 520 aa, Zea mays
MCTRALLPSTTAIYPGAPSSLPRPSLRLRPRPLLAATTPVTSSRADAAAMDPVATWGLTPLAGADPEIYDLLEREKRRQRRGIELIASENFTSFAVMEALGSALTNKYSEGMPGARYYGGNDVIDEIENLCRSRALAAFRLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 37 - DNA, 1875 bp, Zea mays; identical to SEQ ID NO: 9
  CDS (41)..(1621)

SEQ ID NO: 38 - protein, 526 aa, Zea mays
MCTRAHLPSTTAIYPGAPSSLPRPSLRLRLRPRPRPRPLLAATTPVTSSRADAAAMDPVATWGLTPLAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 39 - DNA, 1944 bp, Arabidopsis thaliana; identical to SEQ ID NO: 3
  CDS (177)..(1766)

SEQ ID NO: 40 - protein, 529 aa, Arabidopsis thaliana
MQACCGGNSMASLQQPGRVQGSVFPPIMPPVTKFSQQLKFNISKPFRSSFLKRNLVSEMRASSVSLPNVEISSKEIPFEDYGLGEVDPEVRTIITKEKDRQFRSLELIASENFTSRAVMEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 41 - DNA, 1284 bp, Pyrococcus abyssi
  CDS (1)..(1284)
atggcctacaaggagtatagggacaaggtgttacactttattgaagaacacgagaagtggaggagccatacaataaacttgatcgcaagtgagaacataacttctccaagcgttaacagggccgttgcctctggctttatgcacaagtacgcagagggatggccaaggcaaaggtattaccaaggttgtaagtacgttgatgaggtcgagctcattggagttgaactcttcactaagttattcaagagcgactatgcagatttaagaccaatctctggaactaacgctaatcaagcagtgttcttcgggttagggcagccaggtgataaggttatagttctccacacgagccatggtggacatataagccacatgccattcggggctgctggaatgcgtggtttagaggttcacacatggccattcgataacgaatccttcaacatagacgttgacaaggctgagaagatgataagagagctcgagccaaagatagttgtctttggaggttcattgttcccgttcccgcacccagttaaggagcttgccccagtggctaaggaagttggggcgttcgtagtttacgacgcagcccacgttctcggattaatagccggtggcgagttccaggacccacttagagagggagcagatataatgacagcatcaacccacaagaccttcccagggccacagggaggagtaatactgtacaagaaattcgccgacgatgaaacgatagcaaagctacagtgggcgatcttcccaggtgtgcttagcaaccaccacctccaccacatggctggaaaagtgataacggctgcagagatgctcgagtacggtgaagcgtacgcgaagcagatagttaagaacgcaaaggccctagctgaagccttagcagaggaaggatttaaggtgataggcgaagaccaaggttacaccaagagccatcaagtcatagttgacgtaagcgacctccacccagctggaggaggatgggcagctccactccttgaggaagccggaataattctcaacaagaacttacttccatgggatccactagagaaggttaacgagccaagtggactgagaattggagtccaggagatgacgagagtaggaatgatggaagacgagatgaaggagatagcgcacttcatgaagcgcgttctcttggacaaagaggatccaaagaaggtaaggaaggacgtctactacttcaggctcgagtaccagaaagtctactactccttcgactatggccttccaatgaaggagtga

SEQ ID NO: 42 - protein, 427 aa, Pyrococcus abyssi
MAYKEYRDKVLHFIEEHEKWRSHTINLIASENITSPSVNRAVASGFMHKYAEGWPRQRYYQGCKYVDEVELIGVELFTKLFKSDYADLRPISGTNANQAVFFGLGQPGDKVIVLHTSHGGHISHMPFGAAGMRGLEVHTWPFDNESFNIDVDKAEKMIRELEPKIVVFGGSLFPFPHPVKELAPVAKEVGAFVVYDAAHVLGLIAGGEFQDPLREGADIMTASTHKTFPGPQGGVILYKKFADDETIAKLQWAIFPGVLSNHHLHHMAGKVITAAEMLEYGEAYAKQIVKNAKALAEALAEEGFKVIGEDQGYTKSHQVIVDVSDLHPAGGGWAAPLLEEAGIILNKNLLPWDPLEKVNEPSGLRIGVQEMTRVGMMEDEMKEIAHFMKRVLLDKEDPKKVRKDVYYFRLEYQKVYYSFDYGLPMKE

SEQ ID NO: 43 - DNA, 1489 bp, Hyphomicrobium methylovorum
  CDS (154)..(1458)
cgcaacggccgttcccgcgcccttgttacacggggctcggggtcggttgagtgctggtgtccagcctcgtactatggttcaaagctcgttggccggacttgactccgtgtcctgagcgcgcagttaaatcactttcattttgaaggaaaacacatgtcgtccgcaccggctgcaggtactgcttctacgtcccgttttttcaagtcgcacgtgtcggagacggatcccgatattttcagcgccatccaaaaggaatttggccgccagcagcacgagatcgagctgatcgcgtctgagaacatcgtttcgcaggccgttctcgatgcagctggttcggtgctgaccaacaagtatgccgagggctatccgggcaagcgctactacggcggctgccagtacgtcgacatcgttgaagacatcgcgatcgaccgcgcaaagaagctcttcaactgcgaattcgcgaacgtgcagccgaactccggcagccaggcgaaccagggcgtgttcaatgcgctcgcgcagccgggcgacaccatcctcggtctctcgctcgctgccggtggtcacttgacccacggcgcgccggtgaaccagtccggcaagtggttcaaggccgtgcactacatggtcaagcccgactcgcacctcatcgacatggacgaagtgcgcaagctggcccaggagcacaagccgcgcatcatcatcgctggtggttcggcctatccgcgcaagatcgatttcgctgcatttcgcgcgattgcggatgaggttggcgcgatcttcctcgtcgatatggcgcacttcgccggtcttgttgcggccggtctcattccgagcccgttcccgcatgcccacgtcgtaacgacgacgacgcacaagacgctgcgcggaccccgtggcggcatgattttaacgaacgacgcggacatcgcgaagaagatcaactcggcgatcttccctggcattcagggcggcccgctcatgcacgttatcgccggtaaggccgtcgcattcggcgaggctctgcgtccggacttcaaggtctacatcaagcaggtgatggacaacgcccgcgcgctcggtgaagtgcttgtgcagaacggcttcgcgctcgtttctggcggcaccgacacgcacctcgttctcgtcgatctgcggccgaagaagctgaccggtacgaaggctgagaaggcgcttggccgtgccaacatcacctgcaacaagaacggcattccgttcgaccccgagaagccgatggtgacgtcgggcattcgtttgggttcgcctgcaggcacgacgcgcggcttcggcgttgccgaattccaggaaatcggccgcctgatctcggaagttctggatggcgttgcgaagaacggcgaagatggcaacggcgccgtcgaagcggccgtcaaggcaaaggctatcgctctttgcgatcgcttcccgatttacgcataacgctgtttacgcacatttgaagatatgcttg

SEQ ID NO: 44 - protein, 434 aa, Hyphomicrobium methylovorum
MSSAPAAGTASTSRFFKSHVSETDPDIFSAIQKEFGRQQHEIELIASENIVSQAVLDAAGSVLTNKYAEGYPGKRYYGGCQYVDIVEDIAIDRAKKLFNCEFANVQPNSGSQANQGVFNALAQPGDTILGLSLAAGGHLTHGAPVNQSGKWFKAVHYMVKPDSHLIDMDEVRKLAQEHKPRIIIAGGSAYPRKIDFAAFRAIADEVGAIFLVDMAHFAGLVAAGLIPSPFPHAHVVTTTTHKTLRGPRGGMILTNDADIAKKINSAIFPGIQGGPLMHVIAGKAVAFGEALRPDFKVYIKQVMDNARALGEVLVQNGFALVSGGTDTHLVLVDLRPKKLTGTKAEKALGRANITCNKNGIPFDPEKPMVTSGIRLGSPAGTTRGFGVAEFQEIGRLISEVLDGVAKNGEDGNGAVEAAVKAKAIALCDRFPIYA

SEQ ID NO: 45 - DNA, 2104 bp, Brevibacterium flavum
  CDS (556)..(1860)
ggatcccgcgacaccaatgacaaacggcacagaggtggagggggaagttccgaggaaggtttcggtggctgcggtaagttgctgtcgggccgctacctggaggtgaatcagacgggacagcggaaggtagacttctgccacttcagcgaggtcaatgttttctccgatgcctcgaagttcaatgacttctttttgggtcagcacctgaggcattgagtttctcagctcgcgccattgtgcgcggtcgaaatcaaggtaggggctgaaatctggtgtgcgtggggaaggtttcacaccagttgtgcttgcagcgttttgctctgccatgaatccattgtgcaccttagctactccattagtgtgatcggggttattttttcacttcaatgggtggctaaaagacgtgggcacgtgagtaaactcatgcgcgcgaaacgatggaagtgaacccatacttttatatatgggtatcggcggtctatgcttgtgggcgtacctgtcccgcgagtgaggtcttacgcgcgggattcgtcttgtgaaaggttagctgacctgatgaccgatgcccaccaagcggacgatgtccgttaccagccactgaacgagcttgaacctgaggtggctgctgccatcgctggggaacttgcccgtcaacgcgatacattagagatgatcgcgtctgagaacttcgttccccgttctgttttgcaggcgcagggttctgttcttaccaataagtatgccgagggttaccctggccgccgttactacggtggttgcgaacaagttgacatcattgaggatcttgcacgtgatcgtgcgaaggctctcttcggtgcagagttcgccaatgttcagcctcactccggcgcgcaggctaatgctgctgtgctgatgactttggctgagccaggcgacaagatcatgggtctgtctttggctcatggtggtcacttgacccacggaatgaagttgaacttctccggaaagctgtacgaggttgttgcgtacggtgttgatcctgagaccatgcgtgttgatatggatcaggttcgtgagattgctctgaaggagcagccaaaggtaattatcgctggctggtctgcataccctcgccaccttgatttcgaggctttccagtctattgctgcggaagttggcgcgaagctgtgggtcgatatggctcacttcgctggtcttgttgctgctggtttgcacccaagcccagttccttactctgatgttgtttcttccactgtccacaagactttgggtggacctcgttccggcatcattctggctaagcaggagtacgcgaagaagctgaactcttccgtattcccaggtcagcagggtggtcctttgatgcacgcagttgctgcgaaggctacttctttgaagattgctggcaatgagcagttccgtgaccgtcaggctcgcacgttggagggtgctcgcattcttgccgagcgtctgactgcttctgatgcgaaggccgctggcgtggatgtcttgaccggtggcactgatgtgcacttggttttggctgatctgcgtaactcccagatggatggccaacaggcggaagatctgctgcacgaggttggtatcactgtgaaccgtaacgcggttcctttcgatcctcgtccaccaatggttacttctggtctgcgtattggtactcctgcgctggctacccgtggtttcgatattcctgcattcactgaggttgcagacatcatcggtactgctttggctaatggtaagtccgcagacattgagtccctgcgtggccgtgtagcaaagcttgctgcagattacccactgtatgagggcttggaagactggaccatcgtctaagcttttctttgagttttcatatgtagaaggcatcgtcggcttcggcctggcggtgcttttctcgttgttttgtggttttgtcagaggatgtcatgcgcgttttaattattgataattatgattctttcacgtttaatctcgccacctatgtggaagaggttacgggtcaggcacctgtggtggtgcctaatgatcaagaaatagatgagacgcttttcgacgccgtcatcctctcaccgggccc

SEQ ID NO: 46 - protein, 434 aa, Brevibacterium flavum
MTDAHQADDVRYQPLNELEPEVAAAIAGELARQRDTLEMIASENFVPRSVLQAQGSVLTNKYAEGYPGRRYYGGCEQVDIIEDLARDRAKALFGAEFANVQPHSGAQANAAVLMTLAEPGDKIMGLSLAHGGHLTHGMKLNFSGKLYEVVAYGVDPETMRVDMDQVREIALKEQPKVIIAGWSAYPRHLDFEAFQSIAAEVGAKLWVDMAHFAGLVAAGLHPSPVPYSDVVSSTVHKTLGGPRSGIILAKQEYAKKLNSSVFPGQQGGPLMHAVAAKATSLKIAGNEQFRDRQARTLEGARILAERLTASDAKAAGVDVLTGGTDVHLVLADLRNSQMDGQQAEDLLHEVGITVNRNAVPFDPRPPMVTSGLRIGTPALATRGFDIPAFTEVADIIGTALANGKSADIESLRGRVAKLAADYPLYEGLEDWTIV

SEQ ID NO: 47 - DNA, 1254 bp, Escherichia coli
  CDS (1)..(1254)
atgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgctgctggaaccaggtgataccgttctgggtatgaacctggcgcatggcggtcacctgactcacggttctccggttaacttctccggtaaactgtacaacatcgttccttacggtatcgatgctaccggtcatatcgactacgccgatctggaaaaacaagccaaagaacacaagccgaaaatgattatcggtggtttctctgcatattccggcgtggtggactgggcgaaaatgcgtgaaatcgctgacagcatcggtgcttacctgttcgttgatatggcgcacgttgcgggcctggttgctgctggcgtctacccgaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcgatggagcctgagttcaaaacttaccagcagcaggtcgctaaaaacgctaaagcgatggtagaagtgttcctcgagcgcggctacaaagtggtttccggcggcactgataaccacctgttcctggttgatctggttgataaaaacctgaccggtaaagaagcagacgccgctctgggccgtgctaacatcaccgtcaacaaaaacagcgtaccgaacgatccgaagagcccgtttgtgacctccggtattcgtgtaggtactccggcgattacccgtcgcggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataa

SEQ ID NO: 48 - protein, 417 aa, Escherichia coli
MLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 49 - DNA, 1239 bp, Enterococcus faecalis
  CDS (1)..(1239)
atggattacaaaacgtatgacccagatttatggaatgcaattgcaagagaagaagagcgccaagaaaataacttggaactaatcgcatctgagaatgttgtgtcaaaagcagttatggctgcccaaggaagtattttaacgaataaatacgcagaaggttaccctggcaaacggtactatggtggttgtgaatttatcgatatcgtagaaaatttagctattgatcgtgccaaagaattatttggtgcaaaattcgcgaatgtacaagcccattcaggttctcaagccaatacagcggcatacctttcattggttgaaccaggtgataccattttggggatggatttatcagctggtggtcacttaacacatggttcgcccgttaactttagtggcaaaacctataattttgtcagttatggagtggatccttcaacagaagtaatcgattacgatgtcgtgcgaattttagcaagagaacatcgtccaaaactaatcattgcaggcgcaagtgcgtattcacgaacgattgacttcaaacgtttccgtgaaatcgctgatgaagtagatgccaagttaatggttgatatggcacatattgcaggcttggtagcttcagggttgcacccaaatccagttccgtatgctgatatcgtaacaagtacgacccataaaacattgcgtggtcctcgtggcggtttaattttgacaaatagcgaagaattggcgaaaaaagtaaatagtagtattttcccaggcattcaaggtggcccattggaacatgtgattgccggaaaagccgcagcttttaaagaagctttggatccaagttttgctgaatatagtcagcaagtgattgcaaatgcacaagcgatgacgaaagttttcaatcaagcgccagaagctcgtttaattagtggggcaacagacaaccacttattactgattgaagtgacaggttttggtttaaatggaaaagaagcagaagctattttagatagtgtaaatattactgtcaataaaaattcaattccgtttgaacaattaagtccatttaaaacaagtggtatccgtattggaacgcctgcaattacttcacgtggttttaaagaagaagatgcggtagaagttgctaaattaatcgttcaagtcttaaaagatccagaaaatacagcagttcatgatgaagttaaagcagctgtagcagcgctaactaaaaaatatccattatataactaa

SEQ ID NO: 50 - protein, 412 aa, Enterococcus faecalis
MDYKTYDPDLWNAIAREEERQENNLELIASENVVSKAVMAAQGSILTNKYAEGYPGKRYYGGCEFIDIVENLAIDRAKELFGAKFANVQAHSGSQANTAAYLSLVEPGDTILGMDLSAGGHLTHGSPVNFSGKTYNFVSYGVDPSTEVIDYDVVRILAREHRPKLIIAGASAYSRTIDFKRFREIADEVDAKLMVDMAHIAGLVASGLHPNPVPYADIVTSTTHKTLRGPRGGLILTNSEELAKKVNSSIFPGIQGGPLEHVIAGKAAAFKEALDPSFAEYSQQVIANAQAMTKVFNQAPEARLISGATDNHLLLIEVTGFGLNGKEAEAILDSVNITVNKNSIPFEQLSPFKTSGIRIGTPAITSRGFKEEDAVEVAKLIVQVLKDPENTAVHDEVKAAVAALTKKYPLYN

SEQ ID NO: 51 - DNA, 1266 bp, Haemophilus influenzae
  CDS (1)..(1266)
atgtttacaagaaatatgactatcgctgattacgatccagtattgtggcaagcgattcaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgctgacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatccaaatccactaccgcatgcacatgttgtgacaacaacaactcacaaaacattgggcggtccgcgtggtggtttaattctttcatcttgtggcgatgaagaaatctacaaaaaattacaatcatccgtattccctgcaaaccaagggggtccattagttcatattattgcggcaaaagcagtttgctttaaaggagcattagagcctcaatataaagaataccaagcaaatgtaatcaaaaatgcaaaagcaatggttgaagtatttaaacaacgtggttatgacgttgtgtcaaatggtactgaaaaccacttgttcttagtaagtttcatcaaacaaggattaacaggtaaagcagcagatgcggcattgggcaaagcaaatattaccgtgaataaaaatgctgtaccaaacgatccgcaaaaaccattcgtcacttctggcatccgtgtaggtacaccatctgtgactcgtcgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatga

SEQ ID NO: 52 - protein, 421 aa, Haemophilus influenzae
MFTRNMTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYPNPLPHAHVVTTTTHKTLGGPRGGLILSSCGDEEIYKKLQSSVFPANQGGPLVHIIAAKAVCFKGALEPQYKEYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 53 - DNA, 1254 bp, Pseudomonas aeruginosa
  CDS (1)..(1254)
atgttcagccgtgatttgaccctcgcccgctacgatgccgaactctttgccgcgatggagcaggaagcccagcgccaggaagagcacatcgagctgatcgcctccgagaactacaccagcccggcggtgatggaagcccagggttcggtgctgaccaacaagtacgccgaaggttatccgcacaagcgctactacggcggctgcgagtacgtcgatatcgtcgagcaactggccatcgaccgcgccaagcaactgttcggcgccgattacgccaacgtccagccgcacgccggctcccaggccaacgccgcggtctacctggccctgctgtcggccggcgacaccatcctcggcatgagcctggcccatggcggccacctgacccacggcgccagcgtctcctcctccggcaagctgtacaacgccgtgcagtacggcatcgacgccaatggcctgatcgactacgacgaagtcgagcgcctggccgtggagcacaagccgaagatgatcgtcgccggcttctccgcctattcccaggtcctcgatttcgcccgcttccgcgccatcgccgacaaggtcggcgcctacctgttcgtcgacatggcccacgtcgccggcctggtcgccgctggcgtctacccgaacccggtgccgttcgccgacgtggtcaccaccaccacccacaagaccctgcgcggtccgcgcggtggcctgatcctggcgcgcgccaacgaggagatcgagaagaagctcaactccgcggtattccccagcgcccagggcggtccgctggagcacgtgatcgcggccaaggcggtgtgcttcaaggaagccctgcagccggagttcaagacctaccagcagcaggtcctgaagaacgcccagagcatggcccaggtcttcctggaccgcggtttcgacgtggtttccggcggcacccagaaccacctgttcctgctctccctgatcaagcaggacatcaccggcaaagacgccgacgccgccctcggccgcgcgttcatcaccgtgaacaagaactcggtcccgaacgacccgcgctcgccgttcgtcacctccggcctgcgcatcggtaccccggccgtgaccacccgcggcttcaaggaagccgagtgccgcgagctggccggctggatctgcgacatcctcgagaacatgggcgacgagtccgtggtcgacggcgtacgcgagaaggtcaaggcgatctgcgccaagttcccggtctacggcaactaa

SEQ ID NO: 54 - protein, 417 aa, Pseudomonas aeruginosa
MFSRDLTLARYDAELFAAMEQEAQRQEEHIELIASENYTSPAVMEAQGSVLTNKYAEGYPHKRYYGGCEYVDIVEQLAIDRAKQLFGADYANVQPHAGSQANAAVYLALLSAGDTILGMSLAHGGHLTHGASVSSSGKLYNAVQYGIDANGLIDYDEVERLAVEHKPKMIVAGFSAYSQVLDFARFRAIADKVGAYLFVDMAHVAGLVAAGVYPNPVPFADVVTTTTHKTLRGPRGGLILARANEEIEKKLNSAVFPSAQGGPLEHVIAAKAVCFKEALQPEFKTYQQQVLKNAQSMAQVFLDRGFDVVSGGTQNHLFLLSLIKQDITGKDADAALGRAFITVNKNSVPNDPRSPFVTSGLRIGTPAVTTRGFKEAECRELAGWICDILENMGDESVVDGVREKVKAICAKFPVYGN

SEQ ID NO: 55 - DNA, 1257 bp, Streptococcus pneumoniae
  CDS (1)..(1257)
atgatttttgacaaagatgattttaaagcatatgatgctgatctctggaatgctattgccaaagaagaagaacgccaacaaaataatatcgagttaattgcttcggaaaacgtagtttccaaggctgttatggcagctcaagggtctatcttgacaaataaatatgccgagggttacccaggacgccgttattatggtggaactgatgtagtagacgttgtagagactcttgctattgaacgcgcaaaagaaattttcggtgctaaatttgctaatgtccaaccacattcaggaagccaagctaactgtgcggcttacatgtccttgattgagccaggtgatacggttatgggaatggatttggcagcaggtggacacttgacccacggagctccagttagcttctctggtcaaacctacaactttctttcctatagtgtggatcctgaaacggaacttttggactttgatgctatcttgaaacaagcccaagaagtaaaaccaaaactgattgtagctggtgcttcagcatattctcaaattatcgatttttcaaaattccgtgaaatcgcagatgctgtcggtgcgaagctcatggtggacatggcccatatcgctggtttggttgcggctggccttcatccaagcccagttccatacgctcatatcacaacaacaacgacccacaaaacccttcgtggacctcgtggtggtttgattttgaccaatgacgaagaacttgctaaaaaaatcaattcagctattttcccaggtattcagggcggtcctttagagcatgttgtggcggctaaggcagtttccttcaaagaagttttggatccagccttcaaggaatatgctgccaatgtaattaagaacagcaaggctatggcagatgtcttcttgcaagaccctgatttccgtattatttcaggtggaactgaaaaccatctcttccttgttgatgtgactaaggttgtagaaaacggaaaagttgctcaaaacttgctggatgaagtcaatattaccctaaataaaaattcaatcccttacgaaaccttgtcgccattcaagacaagtgggattcgtatcggagcagcagctattactgcacgtggatttggtgaagaagaaagtcgcaaagtggctgaactcatcattaaaacccttaagaattcagaaaatgaggctgtattagaagaagtgagaagtgcagtcaaagaattgacagatgccttcccattatacgaggactaa

SEQ ID NO: 56 - protein, 418 aa, Streptococcus pneumoniae
MIFDKDDFKAYDADLWNAIAKEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLAAGGHLTHGAPVSFSGQTYNFLSYSVDPETELLDFDAILKQAQEVKPKLIVAGASAYSQIIDFSKFREIADAVGAKLMVDMAHIAGLVAAGLHPSPVPYAHITTTTTHKTLRGPRGGLILTNDEELAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYETLSPFKTSGIRIGAAAITARGFGEEESRKVAELIIKTLKNSENEAVLEEVRSAVKELTDAFPLYED

SEQ ID NO: 57 - DNA, 1260 bp, Salmonella typhi
  CDS (1)..(1260)
atgcggatgttaaagcgtgaaatgaacattgccgattatgatgccgaattgtggcaggctatggagcaggaaaaagtacgtcaggaagagcacatcgaactgatcgcctccgaaaactacaccagcccgcgcgtgatgcaggcgcaggggtctcagctgaccaacaaatacgctgaaggatatccgggcaagcgctactacggcggttgcgaatacgttgatgtcgtagagcagctggctatcgaccgcgcgaaagaactgttcggcgccgactacgctaacgtgcagccgcactccggttctcaggctaacttcgctgtttacaccgcgctgctgcagccgggcgataccgttctgggtatgaacctggcgcagggcggccacctgactcacggctccccggttaacttctccggtaaactgtacaacatcgtaccttacggtatcgatgagtccggtaaaattgactatgacgagatggcgaagctggccaaagagcacaagccgaagatgattatcggtggcttctctgcctactccggtgtggttgactgggcaaaaatgcgtgaaatcgctgacagcatcggcgcatacctgtttgtcgacatggcgcacgtggcgggcctgattgccgcaggcgtttacccgaacccggttccgcacgctcacgttgtcaccaccaccacccacaaaaccctggcgggtccgcgcggcggcctgatcctggcgaaaggcggcgacgaagagctgtacaaaaaactgaactccgccgtcttcccaagcgcgcagggcggcccgctgatgcacgtgatcgcgggtaaagcggtagcgctgaaagaagcgatggagccggagttcaaagtttaccagcagcaggtggcgaaaaacgccaaagcgatggtggaagtgttcctgaaccgcggctacaaagtggtgtctggcggcactgagaaccacctgttcctgctggacctggtggataaaaacctgaccggtaaagaagctgacgccgcgctgggccgtgctaacatcaccgtgaacaaaaacagcgtgccgaacgatccgaagagcccgttcgtgacctccggtatccgtattggttctccggcggttactcgtcgcggcttcaaagaagcggaagtgaaagagctggctggctggatgtgtgacgtgctggacaacatcaatgatgaagccaccattgaacgcgtgaaagcgaaagtgctggatatctgcgcccgcttcccggtttacgcgtaa

SEQ ID NO: 58 - protein, 419 aa, Salmonella typhi
MRMLKREMNIADYDAELWQAMEQEKVRQEEHIELIASENYTSPRVMQAQGSQLTNKYAEGYPGKRYYGGCEYVDVVEQLAIDRAKELFGADYANVQPHSGSQANFAVYTALLQPGDTVLGMNLAQGGHLTHGSPVNFSGKLYNIVPYGIDESGKIDYDEMAKLAKEHKPKMIIGGFSAYSGVVDWAKMREIADSIGAYLFVDMAHVAGLIAAGVYPNPVPHAHVVTTTTHKTLAGPRGGLILAKGGDEELYKKLNSAVFPSAQGGPLMHVIAGKAVALKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDEATIERVKAKVLDICARFPVYA

SEQ ID NO: 59 - DNA, 1560 bp, Chlamydophila pneumoniae
  CDS (1)..(1560)
ttgctaaaagtttttgagaaatttaagaaattcgcaatagtggaaatatttacaaaggtggttgcggtggtttcgttgttgcataagtttttagaaaatgcttcggggaaaaagggacaaagtttagcttcgacagcgtatttagcagctcttgaccatctcttaaatgcgtttccttccattggggagagaatcattgatgagttgaagagccagcgttcccatttaaagatgattgcttctgaaaactattcttcactttcagtgcagttggctatggggaacttgctcacagataagtattgtgaaggaagtccctttaagcgtttctattcctgttgtgaaaatgtagatgctattgagtgggagtgtgtagagacagcgaaagaactttttgctgcggattgcgcttgtgttcagcctcattctggggctgatgctaatttactggcagtaatggccattctcacgcacaaagtccaaggcccagctgtcagtaagttaggttataaaactgtaaacgaattaacagaagaagaatacactctacttaaggctgaaatgtcttcttgtgtttgcttaggaccttcattaaattctggaggccatttgacccatgggaacgtacgtttaaatgtgatgtctaagcttatgcgttgcttcccctatgatgtcaatccggatacggagtgttttgattatgcagagatctcccggttagctaaggagtataaacctaaggtactgatcgcaggatattcttcctattctcgaagattaaactttgcagttttaaaacagattgcagaggattgtggatctgtcttgtgggtagatatggcgcattttgcaggcctagttgctgggggagtgtttgttgatgaagaaaatcctattccttatgcagatatagtgacaacaacaacgcataagacattacgcggtcctcgcgggggattagttttggcaactcgagagtatgaaagcactctcaataaggcgtgtcctttgatgatgggaggtcctctacctcacgtgatagctgctaaaacagtggctttgaaggaagctctctctgtggatttcaagaaatacgctcatcaggttgtaaataatgctcgtcgattagcagagagatttttaagtcatgggctacgtcttttgacgggaggaacagacaaccacatgatggtgattgatttaggttctttgggcatttctggaaaaattgctgaagatatcttgagttccgtaggaattgctgtgaatcggaattcattaccttcagatgctattggtaagtgggacacttcaggtatacgtttaggaacccctgcactaacgactttgggtatgggtatcgatgaaatggaagaagttgcagatattattgtgaaagtattgcgaaatattcgtttaagttgccatgttgaagggagttctaagaaaaataaaggggaacttcctgaagccatagcgcaggaagctagagatcgtgttcgcaacttgttgctgcgtttcccgctctaccctgaaattgatttagaagctttagtttag

SEQ ID NO: 60 - protein, 519 aa, Chlamydophila pneumoniae
LLKVFEKFKKFAIVEIFTKVVAVVSLLHKFLENASGKKGQSLASTAYLAALDHLLNAFPSIGERIIDELKSQRSHLKMIASENYSSLSVQLAMGNLLTDKYCEGSPFKRFYSCCENVDAIEWECVETAKELFAADCACVQPHSGADANLLAVMAILTHKVQGPAVSKLGYKTVNELTEEEYTLLKAEMSSCVCLGPSLNSGGHLTHGNVRLNVMSKLMRCFPYDVNPDTECFDYAEISRLAKEYKPKVLIAGYSSYSRRLNFAVLKQIAEDCGSVLWVDMAHFAGLVAGGVFVDEENPIPYADIVTTTTHKTLRGPRGGLVLATREYESTLNKACPLMMGGPLPHVIAAKTVALKEALSVDFKKYAHQVVNNARRLAERFLSHGLRLLTGGTDNHMMVIDLGSLGISGKIAEDILSSVGIAVNRNSLPSDAIGKWDTSGIRLGTPALTTLGMGIDEMEEVADIIVKVLRNIRLSCHVEGSSKKNKGELPEAIAQEARDRVRNLLLRFPLYPEIDLEALV

SEQ ID NO: 61 - DNA, 1524 bp, Chlamydia trachomatis
  CDS (1)..(1524)
  misc_feature (683)..(975): Each n is a, c, g, or t
ttgcaaggtttaatcagtggaggtggaaatatggcatcgttattggatagatatctgagaaatatttccgacaaaagtcagcaaaatttggcatcagtggcctatttagcatcattagatcatctgttacacgcttttccatctataggacagagcattgtacaagaattaaagagtcagcgatctcgtttaaaaatgattgcttcagaaaacttttcttctctatctgtgcaacttgctatggggaatttacttacagacaagtattgtgaagggagcccattcaaacgattttattcctgttgcgagaatgtggatgcaattgaatgggaatgcgcagagacggcaaaagaattatttggtgcggaaagtgcttttgttcagcctcattctggagccgatgcgaatttattagcgatcatgtcgatcattacacagaagatccagagccctgcggttcaacagttgggatataaaacgatcaatgatctgcctgagcaggaatacgaagcattaaaagctgagatggctcagcacaaatgcctaggcccctctttaaattctggagggcatctgacacatgggactgtgcgcatgaatatcatgtctaaattaatgcattgtctcccttatgaggtgaatttagatactgaattatttgattatgatgagatagcaaaatnagcgaaagaacataagcccaccgttctgatcgcagggtattcgtcttattctagacgattcaactttgccaccttgaagcaaattgcagaagactgtggcgctgttttatgggtggatatggctcatttcgcaggcttggttgctggaggtgtgtttgtaggagaagaaaatcctatgccttatgcagatatcgtgacaacgacgacgcataagactttgcgagggccaagaggtggattggttctagctaaaanagaatatgcaaataccttgaacaaggcttgtctctanatgatgggcggcccacttcctcatgttatagctgctaaagctattgctctgaaagaagctatgacgatcaatttcaggaagtatgcgcataaagtggtagagaatgcacagactttggctgaagtgttccagcggaacgggctacgattactcactggcgggacagataatcacatgttgattattgatctaacttctctaggagtccctggacgtattgcagaagatatgttaacctcagtaggtatcgcagtaaatcgtaatactattccttcagatgcctctgggcagtggaagacttctggtattcgattagggactccagctctgacaacgctagggatgggcagtgccgaaatggaagaagttgcgaatattatcgtgaaagtattgcgaaatattactgtgagaagcaatgctgagagcggttctagtaaaagtgagggagagctgtcagaagggatcgctcaggaagcgagacaacgtgtggctgatttattaggaagattccctctttatcctgaaatcgatctggaaacgctagtttag

SEQ ID NO: 62 - protein, 507 aa, Chlamydia trachomatis
  misc_feature (228)..(325): each Xaa can be any naturally occurring amino acid
LQGLISGGGNMASLLDRYLRNISDKSQQNLASVAYLASLDHLLHAFPSIGQSIVQELKSQRSRLKMIASENFSSLSVQLAMGNLLTDKYCEGSPFKRFYSCCENVDAIEWECAETAKELFGAESAFVQPHSGADANLLAIMSIITQKIQSPAVQQLGYKTINDLPEQEYEALKAEMAQHKCLGPSLNSGGHLTHGTVRMNIMSKLMHCLPYEVNLDTELFDYDEIAKXAKEHKPTVLIAGYSSYSRRFNFATLKQIAEDCGAVLWVDMAHFAGLVAGGVFVGEENPMPYADIVTTTTHKTLRGPRGGLVLAKXEYANTLNKACLXMMGGPLPHVIAAKAIALKEAMTINFRKYAHKVVENAQTLAEVFQRNGLRLLTGGTDNHMLIIDLTSLGVPGRIAEDMLTSVGIAVNRNTIPSDASGQWKTSGIRLGTPALTTLGMGSAEMEEVANIIVKVLRNITVRSNAESGSSKSEGELSEGIAQEARQRVADLLGRFPLYPEIDLETLV

SEQ ID NO: 63 - DNA, 1299 bp, Sinorhizobium meliloti
  CDS (1)..(1299)
atgctttcacagaccaacgacgctttcttcacccgctctctcgccgacagcgatccggaaatcttcggtgcgatcgagaaggagctgggccgccagcgccatgagatcgagctgatcgcctccgagaacatcgtttcacgggccgtgctcgaggcgcagggctcgatcatgaccaacaaatacgccgagggttacccgggcaagcgctattacggcggctgccaatatgtcgatatcgccgaggcactcgcgatcgagcgcgccaagaagctcttcggcgtcaacttcgcgaacgtgcaaccgaattcgggctcccagatgaaccaggcggtcttcctggcgctgctgcagccgggcgacaccttcatgggcctcgacctcaattccggcggccacctgacccatgggtccccggtgaacatgtcgggcaaatggttcaacgtcgtttcctacggcgtgcgcgaagacgatcaccttctcgacatggacgaagtcgccaggaaggcgcgcgagcagaagccgaaactgatcatcgccggcggaacggcctattcccgcatctgggactggaagcgcttccgcgagatcgccgacgaggtgggcgcgtggctgatggtcgacatggcccacatcgccggtctcgtggccggtggccagcatccgtcgccgttcccgcactgccacgttgcgacgacgaccacgcacaagtccctgcgcggcccccgcggcggcatgatcctcaccaatgacgaggaaatcgccaagaagatcaactccgccgtattccccggtctccagggtgggccgctgatgcacgtgattgccgccaaggccgtcgcgcttggcgaggcgctgcagccctccttcaaggattatgcggcccaggtcgtcaagaacgcccgcacccttgccgaaaccttgaaggccaacggcctggatggacatcgtctcggcggtaccgacacccacctgatgcctggtcgacctgcgcaagaagaatgcgaccggcaagcgtgccgaagctgctctcggccgtgctacgtcacctgcaacaagaacggcattcccttcgaccccgaaaagcccttcgtcacctccggcgtgcgcctcggtgcaccggccggtacgacgcgcggcttcaaggaggcggagttcaaggaggtcggcgaactgatcgtcgaggtgctcgacggtctcaaggccgccaattccgacgagggcaatgccgctgtcgaggctggcgtgcgcgagaaggtgatcaagctcaccgaccgcttcccgatgtacggctatatgtga

SEQ ID NO: 64 - protein, 432 aa, Sinorhizobium meliloti
MLSQTNDAFFTRSLADSDPEIFGAIEKELGRQRHEIELIASENIVSRAVLEAQGSIMTNKYAEGYPGKRYYGGCQYVDIAEALAIERAKKLFGVNFANVQPNSGSQMNQAVFLALLQPGDTFMGLDLNSGGHLTHGSPVNMSGKWFNVVSYGVREDDHLLDMDEVARKAREQKPKLIIAGGTAYSRIWDWKRFREIADEVGAWLMVDMAHIAGLVAGGQHPSPFPHCHVATTTTHKSLRGPRGGMILTNDEEIAKKINSAVFPGLQGGPLMHVIAAKAVALGEALQPSFKDYAAQVVKNARTLAETLKANGLDGHRLGGTDTHLMPGRPAQEECDRQACRSCSRPCYVTCNKNGIPFDPEKPFVTSGVRLGAPAGTTRGFKEAEFKEVGELIVEVLDGLKAANSDEGNAAVEAGVREKVIKLTDRFPMYGYM

SEQ ID NO: 65 - DNA, 1242 bp, Listeria monocytogenes
  CDS (1)..(1242)
atggtctatttacaaaagcaagataaggaagtttttgatgcaattaagttagaacttggtagacaacgcgcgaatatcgaattaatcgcatctgagaattttgttagtgagcaagtaatggaagcaatgggttctgtattaacgaataaatatgcagaaggttacccaggaaaacgctattacggcggatgtgaattcgtggatatcgtggaagatttagcacgcgaccgcgcgaaaaaattatttggagctgaatatgcgaacgttcaaccacactcaggtgctcaagcgaatatggcggtttatcatacagtgcttgaaccaggtgataccgtacttggtatgaacctttcacatggtggacatttaacacatggtagtccagttaatttcagtggtgttttatacaattttgttgaatacggcgttcgtgaagatacaaaagagattgattatgatatcgtccgtgaagctgctttaaaacataaaccaaaaatgattgtagctggcgcaagtgcttatccacgtaaaattgattttgctaaattccgtgaaattgctgatgaagttggcgcatacttaatggtagatatggcgcatatcgccggtcttgttgctgctggtttacaccaaaatccagttccttatgctgattttacaacgacaactacccataaaacgcttcgtggacctcgcggtggaatgattttagccaaagcagaatgggaacaaaaattaaataaatcgattttcccaggaattcaaggtggaccattaatgcacgtaatcgcagcgaaagcagtggcgtttggtgaagcgttacaacctgaattcacaacgtattgcgagcaaattattcgtaattctaagaaattagcagaaactcttcaagcgaatgatgttgctgttttaacaggtggttcggataatcatttattattaattgatttaaaaccacttggcttaacaggaaaagcagctgagaaagtattagatgaagttggtattaccgtgaataaaaataccattccattcgaaacggaaagcccatttgtaacaagtggtattcgtgtaggtgttgctgcagtgacgactcgtggattcgatgaagttgcgattgaaaaagtcggcgtacttatttcggaagtactgcataacttagaaaatgaagaagttctcgcagatgtaaaagcacgcgtggctactttaacaaatgaatatccgctttatccaagtttataa

SEQ ID NO: 66 - protein, 413 aa, Listeria monocytogenes
MVYLQKQDKEVFDAIKLELGRQRANIELIASENFVSEQVMEAMGSVLTNKYAEGYPGKRYYGGCEFVDIVEDLARDRAKKLFGAEYANVQPHSGAQANMAVYHTVLEPGDTVLGMNLSHGGHLTHGSPVNFSGVLYNFVEYGVREDTKEIDYDIVREAALKHKPKMIVAGASAYPRKIDFAKFREIADEVGAYLMVDMAHIAGLVAAGLHQNPVPYADFTTTTTHKTLRGPRGGMILAKAEWEQKLNKSIFPGIQGGPLMHVIAAKAVAFGEALQPEFTTYCEQIIRNSKKLAETLQANDVAVLTGGSDNHLLLIDLKPLGLTGKAAEKVLDEVGITVNKNTIPFETESPFVTSGIRVGVAAVTTRGFDEVAIEKVGVLISEVLHNLENEEVLADVKARVATLTNEYPLYPSL

SEQ ID NO: 67 - DNA, 1248 bp, Lactococcus lactis; IL1403
  CDS (1)..(1248)
atgatttttgataaagaagattttgaaagttttgacccagaattgtgggcagccattcatgctgaggaaattcgtcagcaacaaaatattgaattaattgcttcagaaaatattgtttcaaaagcagttatggcagcacaaggttctgttttgacaaataaatatgccgaaggttatcctgggaaacgttattatggcggaacagaagcggttgatgttgtagaaaatttggctattgaacgagcaaaagaacttttcggtgcaaaatttgccaatgttcaacctcattcaggttctcaagccaatgcggcagcttatatggcattaattcaacctggagacacagtcttaggaatggatttaaatgctggcggtcacttgactcatggggcttcagtcaatttttcaggaaaaacttatcattttgttccttatggagttaattctgaaactgagcttttagattatgatgaaattttaaaaattgctaaacaagttcaacctaaactgattgttgctggcgcttctgcctattcacgcctgattgattttgctaagttccgtgaaatcgctgatagtgttggagcaaaattaatggttgatatggcacatattgctggattggtagcgactggtgcgcatcctaatccacttccttatgctgatgtcgttacaacaacaactcataagacactccgtggaccacgtggtggaatgattttgactaacgatgaagctttggccaagaaaattaactctgcaatcttccctggaactcaaggtgggcctttagaacatgtcattgcagcaaaagcagtagcttttaaagaagcacttgatccagaattcacaacctatattgaacaagtcattaaaaatacgcaagcaatggctgaggaatttgctaaagtggaaggcttacgattgatagctggtggttcagataatcatttgcttaatcttaaagttttagacttaggaattaatgggaaagaagctcaagatttattggatagtgttcacatcacacttaataaagaagcaattcctgatgaaacattatcaccatttaaaacttcaggggtgcgaattggagcagcagcaattacatcaagaggatttaaagaagttgaagcgaaaaaagttgcacaattggtctcagaagctttggttaatcacgataatcaagaaaaacttgcggaagttaggaaagcagctttagaactgactcgtcaatttcccttataa

SEQ ID NO: 68 - protein, 415 aa, Lactococcus lactis; IL1403
MIFDKEDFESFDPELWAAIHAEEIRQQQNIELIASENIVSKAVMAAQGSVLTNKYAEGYPGKRYYGGTEAVDVVENLAIERAKELFGAKFANVQPHSGSQANAAAYMALIQPGDTVLGMDLNAGGHLTHGASVNFSGKTYHFVPYGVNSETELLDYDEILKIAKQVQPKLIVAGASAYSRLIDFAKFREIADSVGAKLMVDMAHIAGLVATGAHPNPLPYADVVTTTTHKTLRGPRGGMILTNDEALAKKINSAIFPGTQGGPLEHVIAAKAVAFKEALDPEFTTYIEQVIKNTQAMAEEFAKVEGLRLIAGGSDNHLLNLKVLDLGINGKEAQDLLDSVHITLNKEAIPDETLSPFKTSGVRIGAAAITSRGFKEVEAKKVAQLVSEALVNHDNQEKLAEVRKAALELTRQFPL

SEQ ID NO: 69 - DNA, 1878 bp, Triticum aestivum
  CDS (69)..(1601)
ctcgtgccgaattcggcacgagcctaccgagaggtgcacgaggaggccgcccaccaccaccacccaccatggccatggcgacggcgctccgcaagctctccgcccgcggccagcccctctcccgcctcacgccgctctactccatggcgtccctgccggcgacggaggagagatccgcagtcacctggccgaagcagttgaacgcgccgctggaggaggtcgaccccgagattgccgacatcatcgagctcgagaaggcccgccaatggaaggggctggagctcatcccgtcggagaacttcacctccctgtcggtgatgcaggcggtgggatccgtcatgaccaacaagtacagcgaggggtaccccggcgcgagatactacggtggaaacgaatacattgatatggccgagacgctgtgtcagaaacgtgctttggaggccttcaatttggacccagagaagtggggagtgaatgtgcaacctctatcgggttcacctgccaacttccatgtatacactgctctgctgaagccacatgacagaattatggctctggatcttcctcacggtggacatctttcccatggctaccagactgacacaaagaaaatctcagcagtttcaatattctttgagacaatgccttacagactggatgaaagcactggcttgattgattatgaccagttggagaaaagtgccgttctgtttaggccaaagttgattgttgctggtgctagtgcatatgcccgcctttatgattataaccgcatgcggaagatctgtgacaagcagaaggcagttcttctggcagacatggcacatatcagtgggctagttgctgctggtgtaattccgtctccttttgagtatgcagatgtggtgactaccactacccacaagtcactccgtggtccacgtggagccatgatctttttccggaagggagtgaaagaaataaacaaacaagggaaggaggttaagtatgattttgaggacaaaatcaatgctgctgtcttcccaggtttgcaaggtggaccccataaccatactattactggcctggcagttgcgcttaagcaggcaactactcaggagtacagagcttatcaagagcaagttatgagcaactctgctagatttgctgagagcttaacttcaaaaggctacgatattgtttctggtgggactgataaccatttagttttggtgaacctcaagaaaaagggaatagatggttcacgtgtggagaaggttttagaaaatgtgcatattgcagcaaacaagaacacggttcctggtgatgtttcagctatggtacccggaggcatcaggatgggaacccccgcacttacatcaagaggatttgttgaggaggacttcgccaaggttgctgacttcttcgattcggcagtgaacttggccttgaaggttaaagctgcagcagcaggtaccaaactgaaggactttgttgccactttgcaatccgacagcaacatccaagctgaaattgcaaagcttcgccacgatgtggaggaatatgcgaaacaattcccaacaattggattcgagaaggagaccatgaagtacaagaactaagaactgctgtgtttcaacagcaaaggaagcaaacaagaagcacagctgaggacaagtccatgtaaacaatagatccatgatgaagcgccaccatatgtaaaaggaatccaagcattttacagaatatgggaactttgtcgatagtttcttattgcaggcacatactgtaagatgcttcgctgatatgctataaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 70 - protein, 510 aa, Triticum aestivum
MAMATALRKLSARGQPLSRLTPLYSMASLPATEERSAVTWPKQLNAPLEEVDPEIADIIELEKARQWKGLELIPSENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHGYQTDTKKISAVSIFFETMPYRLDESTGLIDYDQLEKSAVLFRPKLIVAGASAYARLYDYNRMRKICDKQKAVLLADMAHISGLVAAGVIPSPFEYADVVTTTTHKSLRGPRGAMIFFRKGVKEINKQGKEVKYDFEDKINAAVFPGLQGGPHNHTITGLAVALKQATTQEYRAYQEQVMSNSARFAESLTSKGYDIVSGGTDNHLVLVNLKKKGIDGSRVEKVLENVHIAANKNTVPGDVSAMVPGGIRMGTPALTSRGFVEEDFAKVADFFDSAVNLALKVKAAAAGTKLKDFVATLQSDSNIQAEIAKLRHDVEEYAKQFPTIGFEKETMKYKN

SEQ ID NO: 71 - DNA, 1272 bp, Klebsiella pneumoniae
  CDS (1)..(1272)
ctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagtccgcgcgttatgcaggcgcagggctctcagctgaccaacaaatatgctgaagggtatccgggcaagcgttactacggcggctgtgaatacgtcgacgtggttgaacagctggcaatcgaccgcgcgaaagaactgttcggcgctgactatgctaacgtccagccgcactccggctcccaggctaactttgccgtctacaccgcgctgctgcagccgggcgacaccgtgctcggtatgaacctggcgcagggcggccacctgactcacggctccccggttaacttctccggcaaactgtacaatatcatcccttacggtatcgatgagtccggtaaaattgactatgacgacatggcgaagcaggctcaggaacacaaaccgaagatgatcatcggtggtttctccgcttactccggtatcgttgactgggcgaaaatgcgtgaaatcgctgacagcatcggcgcttacctgttcgtcgatatggcgcacgtggcaggcctgattgccgctggcgtgtacccgaacccggttccgcatgctcacgttgtgaccaccaccacccacaaaaccctggcgggtccgcgcggcggcctgattctggcgaaaggcggtagcgaagagctgtacaaaaaactgaactctgcggtattcccaagcgcgcagggcggcccgctgatgcacgttatcgcggcgaaagcggtggcgctgaaagaagcgatggagccagagtttaaagtttaccagcagcaggttgcgaaaaacgctaaagcgatggtggaagtgttcctgaaccgcggctacaaagtggtgtctggcggtactgagaaccacctgttcctgctggatctggtggataaaaacctgaccggtaaagaagctgacgccgctctgggccgcgccaacatcaccgtcaacaaaaacagcgtgccgaacgatccgaagagcccgttcgtaacctccggtatccgtatcggttctccggcagtgactcgccgcggctttaaagaagcggaagtcaaagagctggctggctggatgtgtgacgtgctggacaatatcaatgacgacgcggtcattgagcgcgtgaaaggtaaagtgctggatatctgcgcccgcttcccggtatatgcgtaa

SEQ ID NO: 72 - protein, 423 aa, Klebsiella pneumoniae
LSQEMRMLKREMNIADYDAELWQAMEQEKVRQEEHIELIASENYTSPRVMQAQGSQLTNKYAEGYPGKRYYGGCEYVDVVEQLAIDRAKELFGADYANVQPHSGSQANFAVYTALLQPGDTVLGMNLAQGGHLTHGSPVNFSGKLYNIIPYGIDESGKIDYDDMAKQAQEHKPKMIIGGFSAYSGIVDWAKMREIADSIGAYLFVDMAHVAGLIAAGVYPNPVPHAHVVTTTTHKTLAGPRGGLILAKGGSEELYKKLNSAVFPSAQGGPLMHVIAAKAVALKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDDAVIERVKGKVLDICARFPVYA

SEQ ID NO: 73 - DNA, 1269 bp, Streptococcus pneumoniae
  CDS (13)..(1269)
aggagaagacctatgatttttgacaaagatgattttaaagcatatgatgctgatctctggaatgctattgccaaagaagaagaacgccaacaaaataatatcgagttaattgcttcggaaaacgtagtttccaaggctgttatggcagctcaagggtctatcttgacaaataaatatgccgagggttacccaggacgccgttattatggtggaactgatgtagtagacgttgtagagactcttgctattgaacgcgcaaaagaaattttcggtgctaaatttgccaatgttcaaccacattcaggaagccaagctaactgtgcggcttacatgtccttgattgagccaggtgatacggttatgggaatggatttggcatcaggtggtcatttgactcatggggctcctgttagcttctctggtcaaacctacaactttgtttcttatagtgttgatcctaaaacggaactcttagactttgatgctatcttgaaacaagcccaagaagtaaaaccaaaactgattgtagctggtgcttcagcctattctcaaattatcgatttttcaaaattccgtgaaatcgcagatgctgtcggtgcgaagctcatggtggacatggcccatatcgctggcttggttgcggctggccttcatccaagcccagttccatacgctcatatcacaacaacaacgacccacaaaacccttcgtggacctcgtggtggtttgattttgaccaatgacgaagaacttgctaaaaaaatcaattcagctattttcccaggtattcagggcggtcctttagagcatgttgtggcggctaaggcagtttccttcaaagaagttttggatccagccttcaaggaatatgctgccaatgtaattaagaacagcaaggctatggcagatgtcttcttgcaagaccctgatttccgtattatttcaggtggaactgaaaaccatctcttccttgttgatgtgactaaagttgtagaaaacggcaaagttgctcaaaacttgttggatgaagtcaatattaccttaaataaaaactcaatcccttacgaaagcttgtcaccattcaagacaagtgggattcgtatcggagcagcagccattactgcacgtggatttggtgaagaagaaagtcgcaaagtggctgaactcatcattaaaacccttaagaattcagaaaatgaggctgtattagaagaagtgagaagtgcagtcaaagaattgacagatgccttcccattatacgaggactaa

SEQ ID NO: 74 - protein, 418 aa, Streptococcus pneumoniae
MIFDKDDFKAYDADLWNAIAKEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLASGGHLTHGAPVSFSGQTYNFVSYSVDPKTELLDFDAILKQAQEVKPKLIVAGASAYSQIIDFSKFREIADAVGAKLMVDMAHIAGLVAAGLHPSPVPYAHITTTTTHKTLRGPRGGLILTNDEELAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYESLSPFKTSGIRIGAAAITARGFGEEESRKVAELIIKTLKNSENEAVLEEVRSAVKELTDAFPLYED

SEQ ID NO: 75 - DNA, 1698 bp, Saccharomyces cerevisiae
  CDS (1)..(1698)
atgattctctccgttatctgctggttcttagtccactgtctgttctgtcccccttctgtccaagagatagaatataaaaaagactcattatttttttttaggtacttcgcttattggtggtcaatgagaaaaaaaatactaaaagccatcgcctcttggagaagagcaaactatcaaaaatcatcaagccgacatttccacatcgagtctcatagtctttcaatcatgtttcccagagcttctgcattggccaaatgtatggcaactgttcatcgtcgtgggctactcaccagtggtgcacaatcgctagtctccaaaccagtctcggagggagatccagagatgtttgacatcttgcaacaagaacgtcacagacaaaaacactctatcacccttatcccatcagaaaacttcacctcgaaggccgttatggatttgctaggttctgagctccaaaacaagtattctgaaggttatccaggtgaaagatactacggaggtaacgaaatcatcgataagtccgaatccttgtgtcaagcaagagctctggaactgtacggattagaccctgccaagtggggagttaatgttcaaccattaagcggggcacctgccaatttgtatgtttactccgctatcatgaacgttggtgaaagattaatgggattggatttgccagatggtggtcacttgtctcacgggtaccaacttaagtcaggaacgccaatttctttcatttccaaatacttccaaagtatgccataccatgtcgaccacactacggggctaatcgattacgataacttgcaagtattggccaaggcattcagaccaaaggtgatcgtggccggtacttccgcgtactcgagattaatagactacgctagattcaaggaaatttcccaaggatgcggcgcatatttgatgagtgatatggcacacatatccggtttggtggcagccaatgttgtcccatctccatttgaacattccgatatagttaccacaaccactcacaagtccttgagaggcccaagaggtgctatgattttcttcagaaagggtatcaagtctgtcaccaaaaagggcaaggaaatcccatatgagttagaaaagaaaatcaacttctcagttttcccaggacatcaaggtggtcctcacaaccatactatcggtgcaatggcagtggcattaaagcaagcgatgtctccagaattcaaagaataccaacaaaaaattgtcgacaacagcaaatggtttgctcaggaactaaccaagatgggttataagttggtttccggcggtaccgataaccacttgattgttattgacttatccggtactcaggtagacggtgctcgtgtcgagacaattttaagtgccttgaacattgctgctaacaagaacaccatcccaggtgataagagtgctcttttcccctctggtctaagaatcggtactccagcaatgaccacgagaggatttggccgtgaagagttttctcaagtcgcaaagtacattgattctgccgttaagctcgctgaaaatttgaaaactttggaaccaacaacgaaactagatgcaagatcaagactcaatgagttcaagaagttgtgtaatgaatctagtgaagtcgctgctttgtctggcgagatttccaagtgggtcggtcaataccctgtcccaggtgatatctaa

SEQ ID NO: 76 - protein, 565 aa, Saccharomyces cerevisiae
MILSVICWFLVHCLFCPPSVQEIEYKKDSLFFFRYFAYWWSMRKKILKAIASWRRANYQKSSSRHFHIESHSLSIMFPRASALAKCMATVHRRGLLTSGAQSLVSKPVSEGDPEMFDILQQERHRQKHSITLIPSENFTSKAVMDLLGSELQNKYSEGYPGERYYGGNEIIDKSESLCQARALELYGLDPAKWGVNVQPLSGAPANLYVYSAIMNVGERLMGLDLPDGGHLSHGYQLKSGTPISFISKYFQSMPYHVDHTTGLIDYDNLQVLAKAFRPKVIVAGTSAYSRLIDYARFKEISQGCGAYLMSDMAHISGLVAANVVPSPFEHSDIVTTTTHKSLRGPRGAMIFFRKGIKSVTKKGKEIPYELEKKINFSVFPGHQGGPHNHTIGAMAVALKQAMSPEFKEYQQKIVDNSKWFAQELTKMGYKLVSGGTDNHLIVIDLSGTQVDGARVETILSALNIAANKNTIPGDKSALFPSGLRIGTPAMTTRGFGREEFSQVAKYIDSAVKLAENLKTLEPTTKLDARSRLNEFKKLCNESSEVAALSGEISKWVGQYPVPGDI

SEQ ID NO: 77 - DNA, 1410 bp, Saccharomyces cerevisiae
  CDS (1)..(1410)
atgccttacactctatccgacgctcatcataagttgatcacctctcatttggtggacaccgaccctgaagtggactccattatcaaggatgaaattgaaagacaaaagcactccatcgatttgattgcttctgaaaatttcacctcaacctccgttttcgatgcccttggaactccattgtccaacaaatactctgaaggttatccaggtgctcgttactacggtggtaatgaacacattgacagaatggaaattctatgtcaacaaagagctttgaaagctttccatgttactccagacaaatggggtgttaacgtccaaactttatctggttctcctgctaacttgcaggtttatcaagctattatgaagcctcatgaaagattgatgggtctatacctaccagatggtggtcatttgtctcacggttacgctactgaaaacagaaaaatttctgctgtttccacatacttcgaatctttcccatacagagttaacccagaaaccggtattatcgactacgatactttagaaaagaacgccatcctatatagaccaaaggttcttgttgctggtacttcagcatactgtcgtttaattgactacaagagaatgagagaaatcgccgacaaatgtggtgcttacttgatggtagacatggcccacatttctggtttgatcgccgcaggtgtcatcccatctcctttcgaatacgctgatatcgttaccaccaccactcacaagtctttgagaggtccacgtggtgctatgattttcttcagaagaggtgtgagatctatcaaccctaagaccggtaaggaagttctatacgacttggaaaacccaattaacttctctgttttcccaggtcaccaaggtggtccacacaaccataccattgctgctttggccactgctttgaagcaagctgccactccagaattcaaggaataccaaactcaagtcttgaagaatgctaaggctttggaaagtgaatttaagaacttgggctacagattagtttccaacggtaccgattctcacatggttctagtatccttgagagaaaagggtgttgatggtgctcgtgttgaatacatttgtgaaaagattaacattgctttgaacaaaaactctattccaggtgacaaatctgctttggttccaggtggtgtccgtattggggctccagccatgaccactagaggaatgggtgaagaagatttccacagaattgttcaatacattaacaaggctgtagaattcgctcaacaagttcaacaaagcttgccaaaggatgcttgtagattaaaggacttcaaagccaaggtcgacgaaggctctgatgttttgaacacctggaaaaaggaaatttacgactgggctggcgaatacccattggctgtgtaa

SEQ ID NO: 78 - protein, 469 aa, Saccharomyces cerevisiae
MPYTLSDAHHKLITSHLVDTDPEVDSIIKDEIERQKHSIDLIASENFTSTSVFDALGTPLSNKYSEGYPGARYYGGNEHIDRMEILCQQRALKAFHVTPDKWGVNVQTLSGSPANLQVYQAIMKPHERLMGLYLPDGGHLSHGYATENRKISAVSTYFESFPYRVNPETGIIDYDTLEKNAILYRPKVLVAGTSAYCRLIDYKRMREIADKCGAYLMVDMAHISGLIAAGVIPSPFEYADIVTTTTHKSLRGPRGAMIFFRRGVRSINPKTGKEVLYDLENPINFSVFPGHQGGPHNHTIAALATALKQAATPEFKEYQTQVLKNAKALESEFKNLGYRLVSNGTDSHMVLVSLREKGVDGARVEYICEKINIALNKNSIPGDKSALVPGGVRIGAPAMTTRGMGEEDFHRIVQYINKAVEFAQQVQQSLPKDACRLKDFKAKVDEGSDVLNTWKKEIYDWAGEYPLAV

SEQ ID NO: 79 - DNA, 1254 bp, Borrelia burgdorferi
  CDS (1)..(1254)
atgagagatgatcaaatatttaatttaattgaaaaggaaaaattaagagaaagagagcatattgaacttattgcttctgaaaattttacatctttagagataaggcaggctgttggtagtattttaactaataagtatgccgaaggatatcctttgaatcgatactacggtggttgttcttttattgatgagattgaaactctggcaatttcgagagcaaaagagctttttggcgcaaagtatgccaatgttcaacctcatagcggatctcaggccaatatggctgccataatggctcttattagcccgggtgacaggattcttggtatgcaattatctcatggagggcatttaactcacggcagcagggtaaatttttctggtatattttttaacacttatttttatggtgtttctagagattctgagctaattgattatgatgaagttcttaaaatagctaaagattgcaggccaaatttaataatagctggagcttcttcttattcaagagaaattgattttaaaaaatttagagaaatagcagatgatgtttctgcttatcttttgtgtgatattgctcatattgcaggccttattgttgccggttttcataattcctcaattgatgtggcgcatcttactacaagtactacgcataaaactttaagagggccaagaggtggaataatactttctggaaaggattttgacaaattagtaaactttaatggaaaagagaagcctttgtttaatgctgtaaattctacagtttttcctggaactcaagggggtcctttagttcatgttattgcgggtaaggctattgcattcaaagaagctcttcaagaaagttttaaagaatacattgctaacgtaataaaaaatactaaagttatggctgaatatttcaaatcggaaggatttcgtattgttagtgggggcacagacaatcatttgtttttggttgatcttagtagttcggatctcaccggtgctgatgctgagaaattacttgagagcgtaaatattactttaaataaaaatgctattccttttgataaaaaaagcccttctttggcttctggtattagaattgggggcgctgctattacttctagaggcctaaatgaaagcgattctttaaatgttgctaaatttattgttagagctttaaaggcaaagtctgatattgaattaaaacaaataaaaaaggaagttgtaagatttattagagattttgacatgccttga

SEQ ID NO: 80 - protein, 417 aa, Borrelia burgdorferi
MRDDQIFNLIEKEKLREREHIELIASENFTSLEIRQAVGSILTNKYAEGYPLNRYYGGCSFIDEIETLAISRAKELFGAKYANVQPHSGSQANMAAIMALISPGDRILGMQLSHGGHLTHGSRVNFSGIFFNTYFYGVSRDSELIDYDEVLKIAKDCRPNLIIAGASSYSREIDFKKFREIADDVSAYLLCDIAHIAGLIVAGFHNSSIDVAHLTTSTTHKTLRGPRGGIILSGKDFDKLVNFNGKEKPLFNAVNSTVFPGTQGGPLVHVIAGKAIAFKEALQESFKEYIANVIKNTKVMAEYFKSEGFRIVSGGTDNHLFLVDLSSSDLTGADAEKLLESVNITLNKNAIPFDKKSPSLASGIRIGGAAITSRGLNESDSLNVAKFIVRALKAKSDIELKQIKKEVVRFIRDFDMP

SEQ ID NO: 81 - DNA, 1236 bp, Clostridium acetobutylicum
  CDS (1)..(1236)
atggattttgaaaatataaaagtaagtgattctgaagtctattctatcatagaagaagaaaatgcgagacaagaaaataatatagaacttattgcatctgaaaacttcacaagcaaagctgtaatggaagctatgggttcatatttaactaataagtatgcagaaggatatccaggaaaaagatattatggtggatgttacgtagttgataaagttgaagagcttgcacgtgaaagggcaaaaaaactttttaaagcagagcatgctaatgtacagccacattcaggttcacaagctaatatggctgtttactttgcagtattgaagccgggagacactataatgggaatgaacctaacagatggaggtcatttaactcatggaagtccagttaatttttcaggaaaactctttaatataattgcctatggtgtaagtgatgaaacagaacaaatagattatgaagcgtttagaaaaaaagccttggagtgtaagccaaagatgatagtatctggtgctagtgcatattcaagaattattgattttaagaaaataagagaaatatgcgatgaagtaggagcatatatgatggtagatatggctcatatagcaggacttgtagcagcaggacttcatccgtcaccaattccatatgctgattttgtaacaacaactactcataagactttaaggggaccaagaggcggagcaattttctgcaaggaaaagtatgcaaaggacattgataaatctgtattccctggaatgcaggggggacctttaatgcacataattgcaggaaaagcagtatgctttggagaagctttaaaggatgattttaaagattatgcacagcaaatagtaaataatgcaaaagtgtttgcagatgaacttacaaaatacggttttagaatagtttcaggtggaactgataatcaccttttattagttgatttaacgaacaaaaatataacaggaaaagatgcagaacatcttcttgattcagttggaataactgcaaacaaaaatactataccatttgagaaaaagagtccttttataacaagtggaataagaatgggtacaccttcagttacaactagaggatttaaggaagaggaaatgaaaaaagtagcgtatttcataaactatgttatagagcatagagatgaagatttaagtgaaataaggaaacaagtttcagaattatgtagtggatttcctatatataagtaa

SEQ ID NO: 82 - protein, 411 aa, Clostridium acetobutylicum
MDFENIKVSDSEVYSIIEEENARQENNIELIASENFTSKAVMEAMGSYLTNKYAEGYPGKRYYGGCYVVDKVEELARERAKKLFKAEHANVQPHSGSQANMAVYFAVLKPGDTIMGMNLTDGGHLTHGSPVNFSGKLFNIIAYGVSDETEQIDYEAFRKKALECKPKMIVSGASAYSRIIDFKKIREICDEVGAYMMVDMAHIAGLVAAGLHPSPIPYADFVTTTTHKTLRGPRGGAIFCKEKYAKDIDKSVFPGMQGGPLMHIIAGKAVCFGEALKDDFKDYAQQIVNNAKVFADELTKYGFRIVSGGTDNHLLLVDLTNKNITGKDAEHLLDSVGITANKNTIPFEKKSPFITSGIRMGTPSVTTRGFKEEEMKKVAYFINYVIEHRDEDLSEIRKQVSELCSGFPIYK

SEQ ID NO: 83 - DNA, 1245 bp, Campylobacter jejuni
  CDS (1)..(1245)
atgagtttagaaatgtttgataaagaaatttttgatttaacaaacaaagagttagagcgtcaatgtgaaggtcttgaaatgatagcgagtgaaaatttcactttacctgaagtaatggaagttatgggaagtatcttgacaaacaaatacgcagaaggttatccgggtaaaagatattatggtggttgtgaatttgttgatgagattgaaactctagctattgaaagatgtaaaaaactttttaattgtaaatttgctaatgttcagcctaattcaggttctcaagctaatcaaggtgtttatgcggctttgattaatccaggtgataaaattttaggaatggatttaagtcatggcggacatttaactcatggtgcaaaagtaagttcttcgggcaaaatgtatgaaagctgtttttacggcgtagaacttgatggaagaattgattatgaaaaagtaagagaaattgctaaaaaagaaaaaccaaaacttatagtttgtggagctagtgcttatgcaagagtgattgattttgctaaatttagagaaattgctgatgaaataggtgcctatctttttgctgatatagcacatattgcaggtcttgttgtggcaggtgagcatccaagtccttttccatacgctcatgtagtaagctcaactacacataaaactttgcgtggcccaagaggtggtattattatgacaaatgatgaagagcttgctaaaaaaattaattctgccatttttccaggtattcaaggtggtcctttgatgcatgtaattgctgcaaaagcagtaggatttaaatttaatcttagcgatgagtggaaagtttatgcaaaacaagtaagaactaatgctcaagttttagctaatgttttaatggatagaaaatttaaacttgttagcgatggaacggataatcaccttgttttaatgagttttttagatcgtgaatttagtggaaaagatgcagatttagctcttggaaatgcaggtattactgcaaataaaaataccgttccaggagagattagaagtccttttatcacaagtggattaagacttggaactccagcccttactgccagaggttttaaagaaaaagaaatggaaattgtgtcaaattatattgcagatattttagatgatgttaataatgaaaaattacaagagaatattaaacaagaattaaaaaaacttgcaagtaattttattatttatgaaagggctatgttttga

SEQ ID NO: 84 - protein, 414 aa, Campylobacter jejuni
MSLEMFDKEIFDLTNKELERQCEGLEMIASENFTLPEVMEVMGSILTNKYAEGYPGKRYYGGCEFVDEIETLAIERCKKLFNCKFANVQPNSGSQANQGVYAALINPGDKILGMDLSHGGHLTHGAKVSSSGKMYESCFYGVELDGRIDYEKVREIAKKEKPKLIVCGASAYARVIDFAKFREIADEIGAYLFADIAHIAGLVVAGEHPSPFPYAHVVSSTTHKTLRGPRGGIIMTNDEELAKKINSAIFPGIQGGPLMHVIAAKAVGFKFNLSDEWKVYAKQVRTNAQVLANVLMDRKFKLVSDGTDNHLVLMSFLDREFSGKDADLALGNAGITANKNTVPGEIRSPFITSGLRLGTPALTARGFKEKEMEIVSNYIADILDDVNNEKLQENIKQELKKLASNFIIYERAMF

SEQ ID NO: 85 - DNA, 1494 bp, Chlamydia trachomatis
  CDS (1)..(1494)
atgacttctttattagataaatatttgagaaatatttccgggaaaggacagcaaagtttagcatccgtagcttatttagcagcattagatcatctattacactctttcccatccataggacaaagcatagtacaagaattgaaaagtcagcgatctcgtttgaaaatgattgcttcagagaacttttcttctctatctgttcagcttgctatgggtaatttactcacagataagtattgtgagggaagtccattcaagcgtttttattcttgttgtgagaatgtggacgctattgagtgggagtgcgtggagacggcaaaggaattatttggtgcagaaagtgcttgtgttcagccacattctggagctgatgcaaacttactggctattatgtcgattattacgcagaagatccaaagcccagctgttcagagactgggatacaagacaatcaacgatctcccggaacaagagtatgaggctttaaaggccgaaatgtctcaatacaaatgcctaggcccgtctttaaattctggcggacatttaacgcatgggactgtgcgtataaatgttatgtctaaattgatgcattgtcttccttatgaggtcaacttagataccgagttatttgattatgacgtgatagcgaaaatagcgaaagaacataggcctactgttcttattgcgggctactcttcttattctagacgattaaactttgctacactgaagcaaattgcggaagattgcggtgcagttttatgggtggatatggctcatttcgcaggattagttgctggaggtgtttttatcggagaagaaaatcctattccttatgcagatatcgttacaacaactactcataagactctgcgagggccaagaggggggcttgttttagctaaaaaagaatattctgatactctaaacaaagcttgtccgttaatgatgggaggtccgcttcctcatgtaattgctgccaaagcagtggctttgaaagaggctatgacaataaatttcaggaaatatgcgcaccaggttgtcgaaaatgctcgaactttagctgaaatttttcagcgtaatggtttgagattattaactggaggaaccgataatcatatgctgattatcgacctgacttctcttggagttcctggacgtatcgcggaggatatgttaacctctgtaggtattgcggtgaatcggaattctattccatcggatgcttctggacagtggaaaacttcgggtattcggttaggtacacctgctctaacaacattaggtatgggtagtgctgaaatggaggaagttgcgaatattatcgcgaaagtattgcgaaatattactgtgagacgcaatgctgagggcagttctagtaaaagtgagggagtgctatcggaggagatcgctcaagaagcgagacaacgagtagctgatttattaggaagattccctctttaccctgaaatcgatctggaaacgctagtttag

SEQ ID NO: 86 - protein, 497 aa, Chlamydia trachomatis
MTSLLDKYLRNISGKGQQSLASVAYLAALDHLLHSFPSIGQSIVQELKSQRSRLKMIASENFSSLSVQLAMGNLLTDKYCEGSPFKRFYSCCENVDAIEWECVETAKELFGAESACVQPHSGADANLLAIMSIITQKIQSPAVQRLGYKTINDLPEQEYEALKAEMSQYKCLGPSLNSGGHLTHGTVRINVMSKLMHCLPYEVNLDTELFDYDVIAKIAKEHRPTVLIAGYSSYSRRLNFATLKQIAEDCGAVLWVDMAHFAGLVAGGVFIGEENPIPYADIVTTTTHKTLRGPRGGLVLAKKEYSDTLNKACPLMMGGPLPHVIAAKAVALKEAMTINFRKYAHQVVENARTLAEIFQRNGLRLLTGGTDNHMLIIDLTSLGVPGRIAEDMLTSVGIAVNRNSIPSDASGQWKTSGIRLGTPALTTLGMGSAEMEEVANIIAKVLRNITVRRNAEGSSSKSEGVLSEEIAQEARQRVADLLGRFPLYPEIDLETLV

SEQ ID NO: 87 - DNA, 1281 bp, Mycobacterium leprae
  CDS (1)..(1281)
atggtcgcgccgctggctgaagtcgacccggatatcgccgagctactgggcaaagagctaggccggcaacgggacaccttggagatgatcgcttcagagaactttgtgccgcgctcggttctacaggcccaaggcagcgtgctgaccaacaagtacgctgaggggttgcccggccgacgctattacgacggctgcgagcacgtcgacgtcgtggagaacatcgcccgcgaccgggccaaggcgctgttcggtgccgacttcgccaacgtgcagccgcactcgggggcccaggccaacgccgcggtactgcacgcgctgatgtctccgggggagcggctgctgggtctggatctcgccaatggcggtcatctgacgcatggcatgcggctgaacttctccggcaagctgtatgaaaccggcttttatggcgtcgacgcgacaacgcatctcatcgatatggacgcggtgcgggccaaggcgctcgaattccgcccgaaggtgctgatcgctggctggtcggcctatccgcggattctggacttcgctgcttttcggtcgatcgcagacgaagtcggcgccaagctgtgggtcgacatggcgcatttcgcgggcctggttgcggtggggttgcacccgtctccagtgccgcatgcagatgtggtgtccacgaccgttcacaagactcttggcgggggccgttccggtttgatcctgggcaagcaggagttcgccacggccatcaactcagcggtgtttcctggccagcagggtggaccgcttatgcatgtcatcgcgggcaaggcggtcgcgctgaagattgctaccacgcctgagttcaccgaccggcagcagcgcacgctggccggcgcccggattctcgccgatcggcttaccgccgctgatgtcaccaaggccggggtgtcggtggtcagtggtggcactgacgtccacctagtgctggtcgacctgcgcaactccccgttcgacggccaggcagcagaagatctgctgcacgaggtcggcatcactgtcaaccgcaacgtggttcccaatgacccccggccgccgatggtgacctcaggcctgcggataggaacccccgcgctggcaacccgagggttcggtgaagcggagttcaccgaggtcgcggacatcatcgcgacggtgctgaccactggtggcagtgtcgatgtggccgcgctgcggcagcaggttacccgacttgccagggacttcccgctctacgggggacttgaggactggagcttggccggtcgctag

SEQ ID NO: 88 - protein, 426 aa, Mycobacterium leprae
MVAPLAEVDPDIAELLGKELGRQRDTLEMIASENFVPRSVLQAQGSVLTNKYAEGLPGRRYYDGCEHVDVVENIARDRAKALFGADFANVQPHSGAQANAAVLHALMSPGERLLGLDLANGGHLTHGMRLNFSGKLYETGFYGVDATTHLIDMDAVRAKALEFRPKVLIAGWSAYPRILDFAAFRSIADEVGAKLWVDMAHFAGLVAVGLHPSPVPHADVVSTTVHKTLGGGRSGLILGKQEFATAINSAVFPGQQGGPLMHVIAGKAVALKIATTPEFTDRQQRTLAGARILADRLTAADVTKAGVSVVSGGTDVHLVLVDLRNSPFDGQAAEDLLHEVGITVNRNVVPNDPRPPMVTSGLRIGTPALATRGFGEAEFTEVADIIATVLTTGGSVDVAALRQQVTRLARDFPLYGGLEDWSLAGR

SEQ ID NO: 89 - DNA, 1278 bp, Mycobacterium tuberculosis
  CDS (1)..(1278)
atgaacaccctcaacgactccctgaccgccttcgacccggacatcgccgccctgatcgacggcgagctgcgccgtcaagaatccggcttggagatgatcgcttcggagaactatgcaccgctggccgtgatgcaggcccaaggttcggtcttgaccaacaagtacgccgaaggctacccgggccggcgctactacggtggctgtgaattcgtcgacggtgtcgagcagttggctatcgaccgcgtcaaagcgctctttggcgccgaatacgccaacgtgcaaccacattcgggggccaccgccaacgccgccaccatgcatgcgctgctaaaccccggcgacaccatcctggggttgtcgctggctcatggcggtcacctgacccacgggatgcggatcaacttttccggcaagctctaccacgccaccgcctacgaggtgtccaaagaggactacctggtcgacatggatgccgtcgccgaggcagcgcgcacacaccggcccaaaatgatcatcgccggctggtcggcgtacccacgccagctggatttcgcccgcttccgcgccatcgccgacgaagtcgacgccgtgctcatggtggatatggcgcatttcgccggcctggtcgccgctggcgtgcaccccagcccggtgccgcacgcccacgtcgtcacctccaccactcacaagacgctcggcgggccccgcggcggcatcatcttgtgcaatgacccggccatcgccaagaagatcaattccgcggtcttccctgggcagcagggcgggccgctcgagcatgtcatcgcagccaaggccaccgcattcaagatggcagcacaacctgaattcgcgcagcgccaacaacgttgcctcgacggcgcgcgcatccttgccggccggttgacccagcccgacgtcgccgaacgtggcatcgcggtgctaaccggcggcaccgatgtgcacctcgtcctagtcgacctgcgcgacgccgaactcgacggccagcaagccgaagaccggttggccgccgtggacatcaccgtcaaccgcaacgcggtacccttcgaccctcgtcccccgatgatcacctcgggcctgcgaatcggcaccccggcgctggccgcacgcggcttctcccacaacgacttccgcgccgtggcagacctcatcgcggcggcactgacggccaccaacgacgaccagctgggtccgctgcgcgcccaggtccagcggctggccgcacgctatccgctctacccggaactgcaccggacatga

SEQ ID NO: 90 - protein, 425 aa, Mycobacterium tuberculosis
MNTLNDSLTAFDPDIAALIDGELRRQESGLEMIASENYAPLAVMQAQGSVLTNKYAEGYPGRRYYGGCEFVDGVEQLAIDRVKALFGAEYANVQPHSGATANAATMHALLNPGDTILGLSLAHGGHLTHGMRINFSGKLYHATAYEVSKEDYLVDMDAVAEAARTHRPKMIIAGWSAYPRQLDFARFRAIADEVDAVLMVDMAHFAGLVAAGVHPSPVPHAHVVTSTTHKTLGGPRGGIILCNDPAIAKKINSAVFPGQQGGPLEHVIAAKATAFKMAAQPEFAQRQQRCLDGARILAGRLTQPDVAERGIAVLTGGTDVHLVLVDLRDAELDGQQAEDRLAAVDITVNRNAVPFDPRPPMITSGLRIGTPALAARGFSHNDFRAVADLIAAALTATNDDQLGPLRAQVQRLAARYPLYPELHRT

SEQ ID NO: 91 - DNA, 1251 bp, Neisseria meningitidis
  CDS (1)..(1251)
atgttttcaaaaagcgttaccctcgcacaatatgaccccgatttggcagcagccattgcccaagaagaccaacgccagcaagaccacgtcgagctgattgcctctgaaaactacgtcagctgcgccgtaatggaagcgcaaggttcccagctgaccaacaaatacgccgaaggctaccccggcaaacgctactacggcggctgcgaatacgtcgatattgtcgaacaattggcgattgaccgcgtcaaaaaactgttcggcgcgcaatacgccaacgtccaaccgcactccggctcgcaagccaaccaagccgtgtacgcttccgttttaaaaccaggcgacaccattttgggtatgtctctggcgcacggcggccacctgacccacggcgcgagcgttaatatctcaggcaaactctacaacgctgttacttatggtttggatgaaaacgaagtgctcgattatgccgaagtcgaacgcctcgcgctcgaacacaaacccaaaatgattgtggcgggtgcgtctgcctacgcgttgcaaatcgactgggcaaaattccgcgaaatcgccgataaagtcggcgcatacctctttgtcgatatggcgcactatgccggtctggttgccggcggcgaatatcccaatcccgtgccgttctgcgacttcgttaccaccaccacccacaaaaccctgcgcggtcctcgcggcggcgtaattttgtgccgcgacaatacccacgaaaaagcgttgaactcttccatcttcccaagcctgcaaggtggcccgctgatgcacgttatcgccgccaaagccgtggcgtttaaagaagcattgcaacccgagttcaaacaatacgcaaaacaagtgaaaatcaatgcagccgccatggcggaagagttggttaaacgcggtttgcgcatcgtttccggccgcaccgaaagccacgttttcctcgttgacctgcaaccgatgaaaattaccggcaaagccgccgaagctgctttgggcaaagcgcacatcactgtcaacaaaaacgccatcccgaatgatccggaaaaacccttcgttacctccggcatccgcatcggttccgccgccatgaccacacgcggttttaacgaagccgacgcgcgcgtattggcgaacttggttgccgacgtattgtctaaccccgaagacgaagccaacctcgccaaagtccgcgaacaagtaactgctttgtgcaataaataccccgtttacggcgcgtaa

SEQ ID NO: 92 - protein, 416 aa, Neisseria meningitidis
MFSKSVTLAQYDPDLAAAIAQEDQRQQDHVELIASENYVSCAVMEAQGSQLTNKYAEGYPGKRYYGGCEYVDIVEQLAIDRVKKLFGAQYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAAMAEELVKRGLRIVSGRTESHVFLVDLQPMKITGKAAEAALGKAHITVNKNAIPNDPEKPFVTSGIRIGSAAMTTRGFNEADARVLANLVADVLSNPEDEANLAKVREQVTALCNKYPVYGA

SEQ ID NO: 93 - DNA, 1263 bp, Pasteurella multocida
  CDS (1)..(1263)
atgttaaaaagaagtatgaacatcgctgattacgatccggttttatggcaggcaattcaagacgaaaatcgccgtcaagaagaacacattgaattaattgcatcagaaaactatgccagcccacgcgtgatggaagcacagggttctcaatttaccaataaatatgcggaaggttacccgggtaaacgttattatggtggttgtgaatatgcagatatcgttgagcaattagcgattgatcgtgcaaaagagttatttcatgcggattatgtgaacgtacaaccccactcgggttcgcaagctaacgcggcagtgtatggtgccttattacagccacatgacactattcttggtatgagccttgcacacgggggacacttaacgcacggtgcatcagtgagcttttcgggtaaaatctataatgcagtgcaatatggaattactgccgaaggtttaattgattatgaagatgtgcgtcaaaaagccttagagtgcaagccaaaaatgatcgtggcgggtttctctgcctattcgcaagtagtggattgggcgaaaatgcgtgaaatcgctgatgaagtgggagcgtatcttttcgtggatatggcgcacgtggcagggctgattgcagcaggtgtttacccaagtccgttaccacatgcacatgttgtgactactaccacacacaaaaccttagggggacctcgtggtggtttaattctatcggctgcgaaagatgaagatctttataaaaaattacaaagttctgttttccctgccaaccaaggtggtccgttagtgcatgtgatcgccgcaaaagcggtctgttttaaagaagcgcttgagcctgaatacaaagtgtatcaacaacaagtggtgaaaaatgcgaaagccatggtggacgtgtttaaacaacgtggttataacgtggtatccaatggcacagaaaaccatttattcttagtagatttagttagccacggtttaaccggtaaagcagcagatgctgcgttaggcagtgcaaacattaccgtcaacaaaaatgcggtaccaaacgatccacaaaaaccatttgtgacctcaggtatccgtgtgggcacaccatctatcacccgtcgtggctttaaagaagctgaatcggcagaattagccggttggatgtgtgatgtgttggatgcgatgggtaaagacaacgaagcacaagtgattgcacagacaaaagagaaagtcttagcaatttgtaaacgtcttcctgtttatgcttaa

SEQ ID NO: 94 - protein, 420 aa, Pasteurella multocida
MLKRSMNIADYDPVLWQAIQDENRRQEEHIELIASENYASPRVMEAQGSQFTNKYAEGYPGKRYYGGCEYADIVEQLAIDRAKELFHADYVNVQPHSGSQANAAVYGALLQPHDTILGMSLAHGGHLTHGASVSFSGKIYNAVQYGITAEGLIDYEDVRQKALECKPKMIVAGFSAYSQVVDWAKMREIADEVGAYLFVDMAHVAGLIAAGVYPSPLPHAHVVTTTTHKTLGGPRGGLILSAAKDEDLYKKLQSSVFPANQGGPLVHVIAAKAVCFKEALEPEYKVYQQQVVKNAKAMVDVFKQRGYNVVSNGTENHLFLVDLVSHGLTGKAADAALGSANITVNKNAVPNDPQKPFVTSGIRVGTPSITRRGFKEAESAELAGWMCDVLDAMGKDNEAQVIAQTKEKVLAICKRLPVYA

SEQ ID NO: 95 - DNA, 1257 bp, Streptococcus pyogenes
  CDS (1)..(1257)
atgatttttgataaaggtaatgttgaagactttgataaagagctttgggatgccattcatgctgaagaagaaagacaagaacatcatatcgaattgattgcatctgaaaacatggtttcaaaagctgtcatggcagctcaaggttctgttttaaccaataagtatgcagaaggctatccaggtaatcgctattatggtggaacagaatgtgtggatattgtcgaaacgcttgctattgaacgtgctaagaaacttttcggtgccgcatttgccaatgttcaagcccattccggaagtcaagccaatgcagcagcttatatggccttgattgaggctggtgacaccgtattaggaatggatttggctgcaggtggtcatctcacgcatggctctccagtaaatttttctggaaaaacctaccattttgtgggttactcagtagatactgatactgaaatgttaaattatgaggcgattttagaacaagcaaaggcggtccaaccaaagcttatcgttgcaggggcttcggcctactctagaagcattgattttgaaaagtttcgtgccattgctgatcacgtaggtgcttacttaatggtggacatggctcacatcgctggccttgtagcagcaggtgtgcacccgagtcctgtcccttatgcgcatattgtgacatcaacaacccataaaaccttacgtggtcctcgtggaggcttgatattaaccaatgacgaagctcttgctaaaaagattaattcggccgttttccctggtttacaaggaggacctctggaacacgtgattgctgccaaagcggttgccttcaaagaagccttggatccagcctttaaagactatgcacaagctattattgataatactgcggctatggcagcagtttttgcacaagatgatcgtttccgtctgatctcaggtggtacagataatcatgtctttttagtagatgtcactaaggttattgctaatggtaaactagcgcaaaatcttctggatgaggttaatattacccttaataaaaatgccattccttttgaaaccttgtcgccatttaaaacctcaggtattcgcattggttgtgctgccataaccagccgtggtatgggtgttaaagagagtcagaccattgcccgtcttatcatcaaagccttggttaatcatgatcaagaaactattcttgaagaagtccgtcaggaagtgcgtcagttaaccgatgccttcccactctataaaaagtaa

SEQ ID NO: 96 - protein, 418 aa, Streptococcus pyogenes
MIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDTDTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFKTSGIRIGCAAITSRGMGVKESQTIARLIIKALVNHDQETILEEVRQEVRQLTDAFPLYKK

SEQ ID NO: 97 - DNA, 1254 bp, Salmonella typhi
  CDS (1)..(1254)
atgttaaagcgtgaaatgaacattgccgattatgatgccgaattgtggcaggctatggagcaggaaaaagtacgtcaggaagagcacatcgaactgatcgcctccgaaaactacaccagcccgcgcgtgatgcaggcgcaggggtctcagctgaccaacaaatacgctgaaggatatccgggcaagcgctactacggcggttgcgaatacgttgatgtcgtagagcagctggctatcgaccgcgcgaaagaactgttcggcgccgactacgctaacgtgcagccgcactccggttctcaggctaacttcgctgtttacaccgcgctgctgcagccgggcgataccgttctgggtatgaacctggcgcagggcggccacctgactcacggctccccggttaacttctccggtaaactgtacaacatcgtaccttacggtatcgatgagtccggtaaaattgactatgacgagatggcgaagctggccaaagagcacaagccgaagatgattatcggtggcttctctgcctactccggtgtggttgactgggcaaaaatgcgtgaaatcgctgacagcatcggcgcatacctgtttgtcgacatggcgcacgtggcgggcctgattgccgcaggcgtttacccgaacccggttccgcacgctcacgttgtcaccaccaccacccacaaaaccctggcgggtccgcgcggcggcctgatcctggcgaaaggcggcgacgaagagctgtacaaaaaactgaactccgccgtcttcccaagcgcgcagggcggcccgctgatgcacgtgatcgcgggtaaagcggtagcgctgaaagaagcgatggagccggagttcaaagtttaccagcagcaggtggcgaaaaacgccaaagcgatggtggaagtgttcctgaaccgcggctacaaagtggtgtctggcggcactgagaaccacctgttcctgctggacctggtggataaaaacctgaccggtaaagaagctgacgccgcgctgggccgtgctaacatcaccgtgaacaaaaacagcgtgccgaacgatccgaagagcccgttcgtgacctccggtatccgtattggttctccggcggttactcgtcgcggcttcaaagaagcggaagtgaaagagctggctggctggatgtgtgacgtgctggacaacatcaatgatgaagccaccattgaacgcgtgaaagcgaaagtgctggatatctgcgcccgcttcccggtttacgcgtaa

SEQ ID NO: 98 - protein, 417 aa, Salmonella typhi
MLKREMNIADYDAELWQAMEQEKVRQEEHIELIASENYTSPRVMQAQGSQLTNKYAEGYPGKRYYGGCEYVDVVEQLAIDRAKELFGADYANVQPHSGSQANFAVYTALLQPGDTVLGMNLAQGGHLTHGSPVNFSGKLYNIVPYGIDESGKIDYDEMAKLAKEHKPKMIIGGFSAYSGVVDWAKMREIADSIGAYLFVDMAHVAGLIAAGVYPNPVPHAHVVTTTTHKTLAGPRGGLILAKGGDEELYKKLNSAVFPSAQGGPLMHVIAGKAVALKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDEATIERVKAKVLDICARFPVYA

SEQ ID NO: 99 - DNA, 1308 bp, Vibrio cholerae
  CDS (1)..(1308)
atgaatgcaaatctaaacaaagcttatcccaacgttagccttgagaacttcttctctaccccactggcggcgaccaacgatgcggtatttgccgccattcaagctgaatacacccgccaaaatgaacagatcgaactgattgcctctgaaaacatcgtctctaaagccgtaatgcaggcgcaaggcacttgcctgactaacaaatacgccgaaggttatcccggccgtcgttactacggcggttgtgagcatgttgacagcgttgagcagattgctatcgaacgcgccaaaatgctttttcagtgtcaatacgcaaacgttcaaccacactcaggcgctcaagccaatggcgctgtgatgcttgctctgctgcaaccgggcgacactattatgggtatgtcgctagatgcaggcggtcatctcacgcatggtgcgcgccctgctctttcaggtaaatggttcaatgcggtgcaatacggtgtggatcgccaaaccctcgaaattaactacgattctgttcgtgcactggcgttagagcacaaacccaaaatgatcatcgcaggcggcagtgccattccccgcactatcgattttgctcaatttcgctcaattgtggacgaagttggcgcgctgttgatggtcgatatggcgcacattgccggattggtagcaactggcgcacatccaagcccattgccgcatgctcatgtcgtcaccactaccacacacaaaactctacgtggcccgcgcggcggcatgattttgaccaacagcgaagagatccacaaaaagatcaattctgcggtgttccccggtttacaaggtggcccactgatgcacgtgattgccgctaaagcagtggcatttggtgaagcgctcggccctgaattccgtacttatattgattcggtgatcgataacgcaaaagtgctggctgaagtgttgcaaactcgcgggtgtgacattgtgactggcggaacggatacgcatctcatgttggtcgaccttagacctaaaggtttgaaaggcaaccaagttgaacaagccttagagcgtgccgggatcacgtgtaacaaaaatggcatcccatttgacgaagagaagcctatgattacatcgggcattcgtttaggtacgcctgccggaaccagccgtggtttcggtcgtgaagaattcaaactcatcggtgagtggattggggacgttctggatggtttggtggccagcccagaaggcaacccagacgttgagcaacaagtgcgtaaacaagtgaaagcactgtgccaacgcttcccgctctatcaatag

SEQ ID NO: 100 - protein, 435 aa, Vibrio cholerae
MNANLNKAYPNVSLENFFSTPLAATNDAVFAAIQAEYTRQNEQIELIASENIVSKAVMQAQGTCLTNKYAEGYPGRRYYGGCEHVDSVEQIAIERAKMLFQCQYANVQPHSGAQANGAVMLALLQPGDTIMGMSLDAGGHLTHGARPALSGKWFNAVQYGVDRQTLEINYDSVRALALEHKPKMIIAGGSAIPRTIDFAQFRSIVDEVGALLMVDMAHIAGLVATGAHPSPLPHAHVVTTTTHKTLRGPRGGMILTNSEEIHKKINSAVFPGLQGGPLMHVIAAKAVAFGEALGPEFRTYIDSVIDNAKVLAEVLQTRGCDIVTGGTDTHLMLVDLRPKGLKGNQVEQALERAGITCNKNGIPFDEEKPMITSGIRLGTPAGTSRGFGREEFKLIGEWIGDVLDGLVASPEGNPDVEQQVRKQVKALCQRFPLYQ

SEQ ID NO: 101 - DNA, 1254 bp, Yersinia pestis
  CDS (1)..(1254)
atgttaaagcgtgaaatgaacattgccgattacgatgcagatctgtggcgtgcaatggagcaagaagtcgtgcgtcaggaagaacacatcgaactgattgcgtctgagaactacaccagcccgcgtgttatgcaagcgcagggatctcagttaacgaacaaatatgctgaaggctatccaggcaagcgttattacggtggctgtgaatatgttgatgttgttgaacaattggcaatcgatcgcgctaaagcattatttggtgctgattacgcaaacgttcaacctcattctggttcgcaagctaacgttgctgtttactccgcgctgctgaaacccggtgacaccgtattggggatgaatctggcacacggcggtcacttgacgcatggttcaccagtgaacttctccggcaaactctacaacatcgtcccttatggtattgatgagtcgggtcaaattgattatgaagatctggcacgtcaggcagaaatacataaacccaaaatgattatcggtggcttctccgcctattctggtatcgttgattgggcaaaaatgcgtgaaattgccgacagcattgacgcatggttctttgttgatatggctcatgttgctggtctggttgctgcgggggtttatcctaacccggttccacatgcccacatcgttaccaccacgacgcacaagactctggctggcccacgtggcggtttgattctggcgaaagggggcgatgaagacttgtacaaaaaactgaactcttctgttttccctggtaaccagggtggcccattgatgcatgttatcgcaggtaaagcggtcgcgctgaaagaagcaatggaacctgagtttaaaatttaccaacagcaagtggctaaaaatgcgaaagccatggtggcggtgttcttggagcgcggttacaaagtggtttctggtggtacggataaccacctgttcttgctagatttggtggataaagacatcaccggtaaagacgctgatgcggctttaggccgtgcgaatatcaccgtgaacaaaaacagcgtacctaacgatccgaagagcccgtttgtgacatctggtgtgcgtattggtagcccagcgatcacccgccgtggcttcaaagaagcggaatcccgtgaattggctggctggatgtgtgatgtgttagataacatcaacgatgaagcgaccattgagcgtgtgaaacagaaagttctggctatctgcgctcgtttaccggtttacgcataa

SEQ ID NO: 102 - protein, 417 aa, Yersinia pestis
MLKREMNIADYDADLWRAMEQEVVRQEEHIELIASENYTSPRVMQAQGSQLTNKYAEGYPGKRYYGGCEYVDVVEQLAIDRAKALFGADYANVQPHSGSQANVAVYSALLKPGDTVLGMNLAHGGHLTHGSPVNFSGKLYNIVPYGIDESGQIDYEDLARQAEIHKPKMIIGGFSAYSGIVDWAKMREIADSIDAWFFVDMAHVAGLVAAGVYPNPVPHAHIVTTTTHKTLAGPRGGLILAKGGDEDLYKKLNSSVFPGNQGGPLMHVIAGKAVALKEAMEPEFKIYQQQVAKNAKAMVAVFLERGYKVVSGGTDNHLFLLDLVDKDITGKDADAALGRANITVNKNSVPNDPKSPFVTSGVRIGSPAITRRGFKEAESRELAGWMCDVLDNINDEATIERVKQKVLAICARLPVYA

SEQ ID NO: 103 - DNA, 1266 bp, Alloiococcus otitis
  CDS (31)..(1266)
tggtgtggtaagatagaggaggaaacaggaatgaccaagcaatattttgacaaagaaatttttgcaacaattgagaaggagaggcaaagacaagaagacaatattgaattgattgcttctgaaaactttgtctctgaagaagttttacaggctcaagggtctattttgaccaacaagtacgcagaaggctaccctggcaaacgctattatgggggctgtgaatttgtcgatgtcatcgagcagttggccatagaccgggtcaaagacttgttcgaagctgattatgccaatgtccaaccccactccgggtcccaggccaataacgccgtcttccaagccctgctccagcctggggacacttacttgggtatggacttgagccacggggggcacttaacccacgggtctccggttaacttttctggcattttgtatcatgctgtccactacggagttaacaaggaaacagaactaattgactacgaccaagtccgccaactcgccatagaccaccagccaaagatgatcattgctggctactcggcctatccaagggagttggactttaagaagtttagagacattgctgacgaggttggtgcctatctgatggtggatatggcccactttgctggtttagtcgcagcaggcgtctatcctgaccctgttccttatgcggatgtcatcacctctactacccacaagaccttgcggggacctcggggaggcttaatcctagccaaggcaaaatatgctaaaaaattaaactcggctatttttcccggtagccagggcggtcccttggaacacgtgattgctgggaaggcagtggcctttttagaagctgcccagcctgcctttaaagactatgctaagcagattaaaaagaatgccaaagctatggcagaggtttttgcccaatcagacaaggcccgactgatctcgaatggaacggacaaccacttgctcctccttgatgtaacaggttttggccttaccggtaaagaggccgagaagcttttagaccaggccaaaattaccgttaataaaaacaccattccttttgaaacccggtcaccacaagtgacgtctggtatccgcttagggacaccggctgtgaccactcggggcttcaaagaagaagattgccagcaagttgcccgtttgattatccaagcattggaatcaaatgaccaagaagaggtcctcgaccaagttcgtcaaggtgtagccaacttaaccaaggctatcccactatacaaataa

SEQ ID NO: 104 - protein, 411 aa, Alloiococcus otitis
MTKQYFDKEIFATIEKERQRQEDNIELIASENFVSEEVLQAQGSILTNKYAEGYPGKRYYGGCEFVDVIEQLAIDRVKDLFEADYANVQPHSGSQANNAVFQALLQPGDTYLGMDLSHGGHLTHGSPVNFSGILYHAVHYGVNKETELIDYDQVRQLAIDHQPKMIIAGYSAYPRELDFKKFRDIADEVGAYLMVDMAHFAGLVAAGVYPDPVPYADVITSTTHKTLRGPRGGLILAKAKYAKKLNSAIFPGSQGGPLEHVIAGKAVAFLEAAQPAFKDYAKQIKKNAKAMAEVFAQSDKARLISNGTDNHLLLLDVTGFGLTGKEAEKLLDQAKITVNKNTIPFETRSPQVTSGIRLGTPAVTTRGFKEEDCQQVARLIIQALESNDQEEVLDQVRQGVANLTKAIPLYK

SEQ ID NO: 105 - DNA, 1835 bp, Nicotiana tabacum
  CDS (56)..(1612)
gcacccaaaacacaagtcatttgggtgtgtgtaacagggggagaagctcacaattatggccatggcaacggctcttcgaagactttcctcttctgttgacaaaccaattaagcgtctctataatggcggctctctctattacatgtcatcgttgcctaatgaagctgtttacgagaaggaaaaaaatggtgtcacgtggccaaagcaacttaatgctcctctagaggaggttgatccagaaattgctgacattattgagcttgagaaagcacgccagtggaagggacttgaactcattccttcagaaaatttcacttctgtgtctgtaatgcaagctgttggatctgttatgacaaacaagtacagtgaaggataccctggggctagatactatggaggaaatgagtatattgacatggcggaaaccttatgccagaaacgtgctttagaagccttcaggttggatcctgcaaaatggggagtgaatgtgcagcctctgtcaggatcacctgctaattttcatgtttacactgcacttttaaaacctcatgaaagaatcatggcccttgatcttccccacggtggacatctttctcatggatatcagactgatacaaagaagatatctgccgtctctatattttttgagaccatgccatatagactgaatgagagcactggctacattgactatgaccagcttgagaaaagtgccacactctttaggccaaagttaattgtcgctggtgctagtgcttatgcacgtctttatgactatgcacgtatccgaaaggtttgtgacaaacagaaggctatcatgttggcagatatggctcatattagtgggttagttgcagctggagtcatcccatcaccatttgattatgcagatgttgtgaccaccacaacccacaaatcccttcgcgggcctcgtggtgccatgattttcttccggaagggtgtgaaggaggttaacaagcaaggcaaggaggtgttgtacgactatgaagataaaattaaccaggcagtctttcccggacttcaaggtggtcctcacaaccatacaattactggcttggcagttgctttgaaacaggcaatgactccagaatacagagcttaccaagagcaatgccttagcaactgctcaaaatttgcccaggctttagcgggaatgggttatgaacttgtttctggtggaacagagaatcacttggttttggtgaacttgaaaaacaagggtattgatggttctagggttgaaaaagttttggaagcggtacatattgcagcgaataagaacactgttcctggagatgtatctgccatggtccctggtggcatcagaatggggactcctgcactcacatcaaggggatttattgaggaagattttgtgaaagttgctgaattctttgatgctgctgtgaagatagcagtgaaaataaagactgaagctcaaggaacaaagttgaaagactttgtgacaacactacagtctagcgcttcaatccagtcggagattgcaaaactccgccatggtgtggaggagtatgcaaagcagttccctacaattgggtttgagaaggaaaccatgaagtacaaaaactgagagctcgactgagtatatacacaagggaccaatatccaacatcctcaaggtgaatgggatagacatccaaactgcagttcgctcccaaggattggattgtcatcttttactaatactatgtaaaatccagcagtgtttggttcccaagtttgccactttgtatattaacgattgtaattcttctgaggtccttgaaagcaataaactcctgttgtcacggtaa

SEQ ID NO: 106 - protein, 518 aa, Nicotiana tabacum
MAMATALRRLSSSVDKPIKRLYNGGSLYYMSSLPNEAVYEKEKNGVTWPKQLNAPLEEVDPEIADIIELEKARQWKGLELIPSENFTSVSVMQAVGSVMTNKYSEGYPGARYYGGNEYIDMAETLCQKRALEAFRLDPAKWGVNVQPLSGSPANFHVYTALLKPHERIMALDLPHGGHLSHGYQTDTKKISAVSIFFETMPYRLNESTGYIDYDQLEKSATLFRPKLIVAGASAYARLYDYARIRKVCDKQKAIMLADMAHISGLVAAGVIPSPFDYADVVTTTTHKSLRGPRGAMIFFRKGVKEVNKQGKEVLYDYEDKINQAVFPGLQGGPHNHTITGLAVALKQAMTPEYRAYQEQCLSNCSKFAQALAGMGYELVSGGTENHLVLVNLKNKGIDGSRVEKVLEAVHIAANKNTVPGDVSAMVPGGIRMGTPALTSRGFIEEDFVKVAEFFDAAVKIAVKIKTEAQGTKLKDFVTTLQSSASIQSEIAKLRHGVEEYAKQFPTIGFEKETMKYKN

SEQ ID NO: 107 - DNA, 1239 bp, Staphylococcus aureus
  CDS (1)..(1239)
atgtcttatatcaccaagcaagataaagttatcgcagaagcaatcgagagagaatttcagagacaaaatagcaacatagagttaatcgcatcggaaaattttgtatcggaagcggttatggaagcacaaggttcagtgttgactaataagtatgctgaaggctatccaggacgccgatattatggtggctgtgagtttgtagatgttactgaaagcatcgcaattgatcgtgctaaagcattgtttggagctgaacatgtcaatgttcaaccacattcaggttcacaagcgaacatggctgtttacttagttgcattagaaatgggcgacacagttttaggtatgaatttgagtcatggtggtcacttgacacatggagcgcctgttaattttagtggtaaattctacaatttcgttgaatatggagtagataaagacacagaacgaatcaattatgatgaagttcgtaaattagcggtagagcataagcctaagcttattgtggcaggagcatcagcatattcaagaacaattgacttcaaaaagtttaaagaaatcgcagatgaagtaaacgctaagttaatggtagacatggcacatattgcaggattagtagcggcaggtttacatccaaatccagtagaatatgctgattttgtaacaactacaacacacaaaacattacgcggaccacgtggtggtatgattttatgtaaggaagaatataaaaaagacatagataaaacaattttccctggtattcaaggtggacctcttgagcatgttattgcagcaaaagcagttgcttttggagaagcgttagaaaataatttcaaaacgtatcaacaacaagtggttaaaaacgcaaaagttcttgcagaagcattaattaatgaaggatttagaattgtttctggcggtacagataatcacttagtagctgttgatgtaaaagggtctataggacttactggtaaagaagctgaagagactttagattcagttggtatcacatgtaacaaaaataccattccgttcgatcaagaaaaaccttttgtaacgagtggtatacgtttaggtacacctgctgcaacaacgcgtggatttgatgaaaaagcttttgaggaagttgcaaaaatcatcagtttagcattgaaaaatagtaaagatgaagaaaaattacaacaagctaaagaacgcgttgcgaaattaacagctgaatatcctctatatcaataa

SEQ ID NO: 108 - protein, 412 aa, Staphylococcus aureus
MSYITKQDKVIAEAIEREFQRQNSNIELIASENFVSEAVMEAQGSVLTNKYAEGYPGRRYYGGCEFVDVTESIAIDRAKALFGAEHVNVQPHSGSQANMAVYLVALEMGDTVLGMNLSHGGHLTHGAPVNFSGKFYNFVEYGVDKDTERINYDEVRKLAVEHKPKLIVAGASAYSRTIDFKKFKEIADEVNAKLMVDMAHIAGLVAAGLHPNPVEYADFVTTTTHKTLRGPRGGMILCKEEYKKDIDKTIFPGIQGGPLEHVIAAKAVAFGEALENNFKTYQQQVVKNAKVLAEALINEGFRIVSGGTDNHLVAVDVKGSIGLTGKEAEETLDSVGITCNKNTIPFDQEKPFVTSGIRLGTPAATTRGFDEKAFEEVAKIISLALKNSKDEEKLQQAKERVAKLTAEYPLYQ

SEQ ID NO: 109 - DNA, 1257 bp, Streptococcus pneumoniae
  CDS (1)..(1257)
atgatttctgacaaagatgattttaaagcatatgatgctgatctctggaatgctattgccacagaagaagaacgccaacaaaataatatcgagttaattgcttcggaaaacgtagtttccaaggctgttatggcagctcaagggtctatcttgacaaataaatatgccgagggttacccaggacgccgttattatggtggaactgatgtagtagacgttgtagagactcttgctattgaacgcgcaaaagaaattttcggtgctaaatttgccaatgtccaaccacattcaggaagccaagctaactgtgcggcttacatgtccttgattgagccaggtgatacggttatgggaatggatttggcagcaggtggacacttgacccacggagctccagttagcttctctggtcaaacctacaactttctttcctatagtgtggatcctgaaacggaacttttggactttgatgctatcttgaaacaagcccaagaagtaaaaccaaaactgattgtagctggtgcttcagcctattctcaaattattgacttttcaaaattccgtgaaattgcagatgctgttggggctaagcttatggttgatatggcccacatcgctggcttggttgcagctggtcttcacccaagcccagtgccatacgctcatatcactacaacaacgacccacaaaacccttcgtggtcctcgtggtggtttgattttgaccaatgatgaggatttagctaagaaaatcaattcagctattttccctggtattcagggtggtcctttggagcatgttgtggctgctaaggcagtttccttcaaagaagttttggatccagctttcaaggaatatgctgccaatgtaattaagaacagcaaggctatggcagatgtcttcttgcaagaccctgatttccgtattatttcaggtggaactgaaaaccatctcttccttgttgatgtgactaaggttgtagaaaacggaaaagttgctcaaaacttgctggatgaagtcaatattaccctaaataaaaattcaatcccttacgaaaccttgtcaccattcaagacaagtgggattcgtatcggagcagcagctattactgcacgtggatttggtgaagaagaaagtcgcaaagtggctgaactcatcattaaaacccttaagaattcagaaaatgaggctgtattagaagaagtgagaagtgcagtcaaagaattgacagatgccttcccattatacgaggaataa

SEQ ID NO: 110 - protein, 418 aa, Streptococcus pneumoniae
MISDKDDFKAYDADLWNAIATEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLAAGGHLTHGAPVSFSGQTYNFLSYSVDPETELLDFDAILKQAQEVKPKLIVAGASAYSQIIDFSKFREIADAVGAKLMVDMAHIAGLVAAGLHPSPVPYAHITTTTTHKTLRGPRGGLILTNDEDLAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYETLSPFKTSGIRIGAAAITARGFGEEESRKVAELIIKTLKNSENEAVLEEVRSAVKELTDAFPLYEE

SEQ ID NO: 111 - DNA, 1239 bp, Staphylococcus epidermidis
  CDS (1)..(1239)
atgtcttatatcgagaaaaaggataaagttgtttacgatgctattcaaaaggagtttcaacgacaaaatagtaatattgaactcattgcatcagaaaatttcgtatcacaagcagttatggaagcccaaggttcagtattaacgaataaatatgctgagggttatcctgggcgtcgttattatggagggtgtgagcatgtagatgtaactgagtccattgccattgaaagagcaaaagctttatttggagcagaacatgttaatgttcaaccccattcaggttctcaagctaatatggctgtgtatttggttgctttagaaatgggcgatactgtgttaggtatgaatttgagtcatggtggtcatttaacacatggggcaactgtcaattttagtggtaaattttatcattttgttgaatatggtgtggaccaagaaaatgaattaataaactatgatgaagtgagacgtttagcaattgagcatcaacctaaattaattgtagctggtgcttcagcatattcaagaactattgactttaaaaaatttaaagaaattgctgatgaagtaggagctaaattgatggtagatatggcacatattgctggtttagtagctgctggtttacatcctaatcctttagaatatgctgattttgtgactactacaactcataaaactttacgcggtccacgtggtggtatgattttatgtaaagaagaatataaaaaagatatagataaaacaatcttcccaggtattcaaggcggtccattagaacatgtcatcgccgcaaaagctgttgcatttggagaagctttgaacgacgattttaaagattatcaaaatcaagtcattaaaaatgcacaagctttagctcaaacattaattgaagaaggcttcagagttgtatctggcggaacagacaatcatttagttgcagttgatgttaaaggttctatcaatatgactggtaaattagctgaagagacacttgataaagtaggaattacatgtaataagaatactattccatttgataaagaaaaaccgtttgtaacaagtggtgttagactaggaacaccagcagctacaactcgtggttttgatgaatctgcatttgtggaagtagcaaaaattattagtttagcattaaataactatgataatgatactaaactaaatgaagctaaagagagagttcacgcactcacatctaaatatccattatataattaa

SEQ ID NO: 112 - protein, 412 aa, Staphylococcus epidermidis
MSYIEKKDKVVYDAIQKEFQRQNSNIELIASENFVSQAVMEAQGSVLTNKYAEGYPGRRYYGGCEHVDVTESIAIERAKALFGAEHVNVQPHSGSQANMAVYLVALEMGDTVLGMNLSHGGHLTHGATVNFSGKFYHFVEYGVDQENELINYDEVRRLAIEHQPKLIVAGASAYSRTIDFKKFKEIADEVGAKLMVDMAHIAGLVAAGLHPNPLEYADFVTTTTHKTLRGPRGGMILCKEEYKKDIDKTIFPGIQGGPLEHVIAAKAVAFGEALNDDFKDYQNQVIKNAQALAQTLIEEGFRVVSGGTDNHLVAVDVKGSINMTGKLAEETLDKVGITCNKNTIPFDKEKPFVTSGVRLGTPAATTRGFDESAFVEVAKIISLALNNYDNDTKLNEAKERVHALTSKYPLYN

SEQ ID NO: 113 - DNA, 1257 bp, Pseudomonas aeruginosa
  CDS (1)..(1257)
atgttcagcaagcacgaccagctccagggctacgacgacgaactgctcgccgcgatggacgccgaagaccggcggcaggaagaccacatcgaactgatcgcctcggagaactacgccagcaagcgggtcatgcaggcgcagggcggcggcctgaccaacaagtatgccgagggctatccgggcaagcgttactacggcggctgcgaacacgtcgacaaggtcgagcggctggccatcgaccgcgccaggcaactgttcggcgccgactacgccaacgtccagccgcactccggttcctcggccaacgctgcggtgtacctggcgctgctcaacgccggcgacaccatcctcggcatgagcctggcccacggcggccatctcacccacggcgccaaggtgtcctcctccggcaagctgtacaacgccgtgcagtacggcctggacaccgctaccgggctgatcgactacgacgaagtcgagcgcctggccgtggagcataagccgaagatgatcgtcgccggcttctccgcctactccaagaccctcgacttcccgcgcttccgcgccatcgccgacaaggtcggcgcgctgctgttcgtcgacatggcccacgtcgccgggctggtcgccgccggcctctacccgaacccgatccccttcgccgacgtggtcaccaccaccacccacaagaccctgcgcggcccgcgcggcggcctgatcctggcgcgcgccaacgaggagatcgagaagaagctcaactccgcggtattccccggcgcccagggcggcccgctgatgcacgtgatcgcggccaaggcggtgtgcttcaaggaagcgctggagccgggcttcaaggactaccaggcgcaggtgatccgcaacgccaaggcgatggccgaggtgttcatcgggcgcggctacgacgtggtttccggtggcaccgacaaccacctgatgctgatcagcctggtgaagcaggggctgaccggcaaggccgccgacgcggcgctcggagcggcgcacatcacggtgaacaagaacgccgtgccgaacgatccgcagagcccgttcgtcacctccggcatccgcatcggcaccccagcggtgaccactcgcggtttccgcgagggcgagtgccgagaactggctggctggatctgcgacatcctcgacgatatcgacaatcccgaggtcggcgaacgggtcaggggccaggtcggcgaattctgccggcacttcccggtctacgctgattga

SEQ ID NO: 114 - protein, 418 aa, Pseudomonas aeruginosa
MFSKHDQLQGYDDELLAAMDAEDRRQEDHIELIASENYASKRVMQAQGGGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVKQGLTGKAADAALGAAHITVNKNAVPNDPQSPFVTSGIRIGTPAVTTRGFREGECRELAGWICDILDDIDNPEVGERVRGQVGEFCRHFPVYAD

SEQ ID NO: 115 - DNA, 1254 bp, Pseudomonas aeruginosa
  CDS (1)..(1254)
atgttcagcaagcatgaccagatccgcggctacgacgacgaactgctcgccgcgatggacgccgaagaggcccgccaggaagaccatctcgaactgatcgcctcggagaactacaccagcaagcgggtcatgcaggcgcagggcagcggcctgaccaacaagtatgccgagggctatccgggcaagcgctactacggcggctgcgaacacgtcgacaaggtcgagcggctggccatcgaccgcgccaggcaactgttcggcgccgactacgccaacgtccagccgcactccggttcctcggccaacgctgcggtgtacctggcgctgctcaacgccggcgacaccatcctcggcatgagcctggcccacggcggccatctcacccacggcgccaaggtgtcctcctccggcaagctttacaacgccgtgcagtacggcctggacaccgctaccgggctgatcgactacgacgaagtcgagcgcctggccgtggagcataagccgaagatgatcgtcgccggcttctccgcctactccaagaccctcgacttcccgcgcttccgcgccatcgccgacaaggtcggcgcgctgctgttcgtcgacatggcccacgtcgccgggctggtcgccgccggcctctacccgaacccgatccccttcgccgacgtggtcaccaccaccacccacaagaccctgcgcggcccgcgcggcggcctgatcctggcgcgcgccaacgaggagatcgagaagaagctcaactccgcggtatttcccggcgcccagggcggcccgctgatgcacgtgatcgcggccaaggcggtgtgcttcaaggaagcgctggagccgggcttcaaggactaccaggcgcaggtgatccgcaacgccaaggcgatggccgaggtgttcatcgggcgcggctacgacgtggtttccggtggcaccgacaaccacctgatgctgatcagcctggtgcgccagggcctgaccggcaaggaagccgacgccgccctcggccgggtcggcatcacggtgaacaagaacgccgtgccgaacgatccgcagagcccgttcgtcacctccggcatccgcatcggcaccccggccatcaccacccgcgggctgcaggaagcgcagagccgcgaactggccggctggatctgcgacatcctcgaccacctcggcgatgccgacgtggaggccaaggtcgccacccaggtcgccggtctctgcgcggacttcccggtctatcgctga

SEQ ID NO: 116 - protein, 417 aa, Pseudomonas aeruginosa
MFSKHDQIRGYDDELLAAMDAEEARQEDHLELIASENYTSKRVMQAQGSGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVRQGLTGKEADAALGRVGITVNKNAVPNDPQSPFVTSGIRIGTPAITTRGLQEAQSRELAGWICDILDHLGDADVEAKVATQVAGLCADFPVYR

SEQ ID NO: 117 - DNA, 1257 bp, Streptococcus agalactiae
  CDS (1)..(1257)
atgatttttgataaagacaattttaaagaatttgaccaagaactttggcaggctattcatgatgaggaaattcgccaacaaaataatattgaattaattgcatcagaaaacgttgtttcaaaagctgttatggcagcacaaggttctgttttgacaaataaatatgccgaagggtatcctagtcatcgttattatggaggaacagattgtgttgatgtagttgaaagtttagctatagaacgagctaagacgttatttaatgctgagtttgctaatgttcaaccacattctggtagtcaggctaatgcagcagcttacatggctttaatcgagccgggagatactgtcttagggatggacttagcagcaggtgggcacttaacacatggcgcttcagttagcttctcaggaaaaacttatcattttgtttcttattctgttgatcctaagacggagatgctagactatgataacattttgaaaatagcacaggaaacgcagcctaaattaattgttgcaggggcatcggcttattctcgcattattgattttgaaaaatttcgtcaaatagcagacgcagtagatgcttacttaatggttgatatggctcacattgcaggtttagttgcttctggtcatcaccctagtcctattccttatgctcatgtaacgacaacgacaacacataagactctacgtggacctagaggtggtttgattttaaccaatgatgaagcaattgctaaaaaaattaattctgcagtctttccaggactccaaggtggaccattagaacatgtaattgctgcaaaagctgtagctttgaaagaagccctagatccttcctttaaaatatacggtgaggatattattaaaaatgctcaagccatggctaaagtttttaaagaagatgatgactttcatttgatttctgatggtactgataatcatttgttcttagtagacgtcacaaaagttattgagaatggcaaaaaggcacaaaatgttcttgaagaagtcaatatcactcttaacaagaactctataccgtttgagcgactatcaccatttaaaacatcaggtattcgaattggtactccagcaattactagtcgaggaatgggagttgaagaatctcgaagaatcgctgaattaatgattaaggcactcaaaaatcatgaaaatcaagatatcctcacagaagttcgtcaagaaattaaatcattaacggacgctttccccttgtatgagaattaa

SEQ ID NO: 118 - protein, 418 aa, Streptococcus agalactiae
MIFDKDNFKEFDQELWQAIHDEEIRQQNNIELIASENVVSKAVMAAQGSVLTNKYAEGYPSHRYYGGTDCVDVVESLAIERAKTLFNAEFANVQPHSGSQANAAAYMALIEPGDTVLGMDLAAGGHLTHGASVSFSGKTYHFVSYSVDPKTEMLDYDNILKIAQETQPKLIVAGASAYSRIIDFEKFRQIADAVDAYLMVDMAHIAGLVASGHHPSPIPYAHVTTTTTHKTLRGPRGGLILTNDEAIAKKINSAVFPGLQGGPLEHVIAAKAVALKEALDPSFKIYGEDIIKNAQAMAKVFKEDDDFHLISDGTDNHLFLVDVTKVIENGKKAQNVLEEVNITLNKNSIPFERLSPFKTSGIRIGTPAITSRGMGVEESRRIAELMIKALKNHENQDILTEVRQEIKSLTDAFPLYEN

SEQ ID NO: 119 - DNA, 1254 bp, Legionella pneumophila
  CDS (1)..(1254)
atgtttgacgaaagttatagtataaaaaattttgatgatgttctttttaaagcaatttctgatgaaaaacgacgccaagaagaacacattgaattaatagcatctgaaaattatgtcagcccgagagtattggaggctcagggttctgtgttgacgaataaatacgctgaaggatatccaggcaaacgctattacggaggttgtgagtttgttgatgtcgctgaggagttagccatttcaagggcaaaattactttttggcgctcattatgtcaatgtgcaaccgcattcgggatcacaagcgaacgcagcagtcatgatggcattattgtccccaggcgatacttttatgggcatggctttacctcatggtgggcacttgactcatgggtcaaaggttaatttttcaggtaaattataccattctgtcgagtatggtgttgatagcaatacgggtttgattgattatgatgctctggaaaaacttgcgcttcaacacaaaccaaaattgatcattgccggtttttcagcttattccaggatcctggattgggctcgatttagagaaattgccgataaggtcggcgcttatttaatggcggacatcgctcatgtagctggtctggtggctgtagggttatatccttctcctgttccttatgcggatgttgtgacaacgacaactcataaaactttaagaggacctcgcggtggtttaatcctttgtaaggaaaacgaagaaattgagaaaaaattaaattcttctgtatttcctggtatgcaaggtgggcccttaatgcatgtaattgcagccaaggcagttgcttttgcagaagctctgttacccgaattcaaaacttatcagcaacaggttttagctaatgccagaacgatgtgcagtgtgttacaaagcagaggctatgatattgtttctggcggaactgataatcatcttttgctagtggatttgataaataaaggaattacaggtaaagaagctgacgctgctgtaggcagagctaacataacagtcaataaaaattcggttcccaatgatcctcgctcgccttttgtaacgagtggtttacgtttgggtacgcctgctgcaaccacaagaggctttaaagaaagagagattactttgttatctaactgggtagcggatgtccttgataatgttcatgatgaaactaatatttcaagagtgaaaacccaggtgttgctactctgtcgtgaatttccggtttatgcctaa

SEQ ID NO: 120 - protein, 417 aa, Legionella pneumophila
MFDESYSIKNFDDVLFKAISDEKRRQEEHIELIASENYVSPRVLEAQGSVLTNKYAEGYPGKRYYGGCEFVDVAEELAISRAKLLFGAHYVNVQPHSGSQANAAVMMALLSPGDTFMGMALPHGGHLTHGSKVNFSGKLYHSVEYGVDSNTGLIDYDALEKLALQHKPKLIIAGFSAYSRILDWARFREIADKVGAYLMADIAHVAGLVAVGLYPSPVPYADVVTTTTHKTLRGPRGGLILCKENEEIEKKLNSSVFPGMQGGPLMHVIAAKAVAFAEALLPEFKTYQQQVLANARTMCSVLQSRGYDIVSGGTDNHLLLVDLINKGITGKEADAAVGRANITVNKNSVPNDPRSPFVTSGLRLGTPAATTRGFKEREITLLSNWVADVLDNVHDETNISRVKTQVLLLCREFPVYA

SEQ ID NO: 121 - DNA, 1981 bp, Oryza sativa
  CDS (43)..(1584)
cccccgcctccaccaccacccgccgctcgccgctcgcccaccatggccatggcgacggcgctccgcaagctctcctccgacgccctccgccgccagccgctctcccgcatcaccccgctctactacatggcgtccctgccggcgacggaggagagatccggagtcacctggccgaagcagctgaacgcgccgctggaggaggtggatcccgagatcgccgacatcatcgagcacgagaaggcccgccaatggaagggtctggagctcatcccgtcggagaacttcacctcggtgtcagtgatgcaggcggtgggatccgtcatgaccaacaagtacagcgaggggtaccccggcgcgagatactacggtggaaacgaatacattgatatggccgagtcattgtgccagaaacgtgctttggaggccttccgcttggacccagcgaaatggggagtgaatgtgcaacctctatcagggtcacctgccaacttccatgtttacactgccctattgaaaccacatgagagaatcatggctttggatcttcctcatggtggacatctttctcacggctaccagactgatactaagaagatttcagcagtttcgatattctttgagacaatgccctacagattggatgaaagcactggcttgattgattatgatcagatggagaaaagtgccgttctttttaggccaaagttgatcgttgcgggtgcaagtgcatatgcgcgtctttatgactatgaccgcatgcggaaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggttatgtatgactttgaggacaagatcaatgctgctgtcttcccaggtctgcaaggtggaccacataatcataccattactggcttagctgttgcgcttaagcaggcaactactccggagtacagagcttatcaagagcaagttatgagtaactgtgcaaaatttgcacagagcttgacagcaaaaggctacgaacttgtctctggtgggactgacaaccatttagtgttggtaaatctcaagagcaagggcatagatggttcaagagtggagaaggttttagaaaacgtgcacattgcagcaaacaagaacacagttcctggtgatgtttcagctatggtaccaggaggcatcaggatgggaaccccagcactgacctcaagaggatttgttgaggaggactttgctaaggttgctgatttcttcgatgcagcagtgaacttggctttgaaggttaaggctgcagcaggtggaacaaaactgaaggactttgttgccactttgcaatctgatagcaacattcaatccgagattgcaaaacttcgccatgatgtggaggaatatgcaaaacagttccccacaattgggtttgagaaagaaaccatgaagtacaagaactaagaaactttgaatggaacagcaagggtaaaagaaaaggcatcaagctgaattcctgaggtgactgttggaattcttgcaagaacaagtcggtgtaaacatatatccatggagtgccatcttatgtaaaagggacccctggcattttacagcgtgtggaaactttgtcaatagttcttatcgtagacacctactgtaagatgttatgctaatgctatattaaccttcactatcttcttggacaagcagttacacatactttggtgtattctgtgaataattcgcatgattgcggaatttttcgtgtttataaatcgtaacttgtaatcttttggccctgcacgcaatttgaaagccctcgatcggattgtcgtttactgcacacaaaaaaaaaaaaaaa

SEQ ID NO: 122 - protein, 513 aa, Oryza sativa
MAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 123 - DNA, 1761 bp, Brassica napus
  CDS (28)..(1581)
gagagagaggcagagaggttggtgagaatggcgatggctatggctcttcggaggctttcttcttcagttgacaaacctattcgtcctcttatcagatcatcttcatgctacatgtcttctttaccaagtgaagctgttgatgacaaggagaggtctcgtgtcacttggccaaaacagcttaacgcatctttggaggaagttgatcctgagattgctgacatcattgagcatgagaaagctagacaatggaagggacttgaactcattccatctgagaatttcacatctgtctcggtgatgcaagctgttggctctgtgatgactaacaagtacagtgaagggtaccctggtgctagatactatggaggaaatgagtacatagacatggcggaaaccttgtgccagaagcgtgctcttgaagctttccggttagaccctgagaagtggggagtcaatgtgcaacctttgtctggatctcctgccaacttccatgtgtacactgcattgttgaagcctcatgagagaatcatggcacttgatcttcctcatggtggtcatctttctcatggttaccagactgacaccaagaagatatctgctgtgtctatcttttttgaaactatgccctaccgcttggacgagagcactggcttcatcgactacgaccagatggagaagagtgctactcttttcaggccaaaactgattgttgctggtgcaagtgcttatgctcgattgtatgactatgcccgcatccgaaaggtgtgtaacaagcaaaaagctgtgatgctagcagatatggcacacataagcggtttggttgcagctggtgtaatcccttcaccgttcgaatatgcagatgttgtaaccaccacaactcacaagtcacttcgtggacctcgtggtgccatgattttctacagaaagggtgttaaggaaattaacaaacaagggaaagaggttatgtatgattttgaagacaagatcaatcaagctgtcttccctggtcttcaaggtggtccacacaaccacactattacaggactagctgttgctttaaaacaggcaactacttcagagtacaaagcataccaagagcaagtcctcagtaactctgcaaagtttgctcagactctgatggagaaaggttatgaacttgtttctggtggaactgacaaccatctggttctagtgaacctgaagcccaagggaattgatggatctagagttgagaaagtactggaagctgttcacattgcatccaacaaaaacactgttcctggagatgtttctgccatggttcctggtggaatcagaatgggtactcctgctctcacttccagaggctttgttgaggaagactttgccaaagtagctgagtactttgacaaagctgtgaagttggctctcaaagtcaaatctgaagctcaaggaaccaaactgaaagattttgtgtcagcaatggaatcatcttcagccattcaatcagagattgccaagctgcgccacgacgtggaggagttcgctaagcagttcccaactattgggtttgagaaagaaaccatgaagtacaagaactgaacatgtctttatccctacaaacaagtcttttattatgatgatgctttgaacttccatgtaatgtatagataatatgatacatgtactctatctttatggtatgcgaaaagatactgtactttctatgcaaatctttttcttaaaaaaaaaaaaaaaaaaaaaaaaaaaaaaaaaaaaaaa

SEQ ID NO: 124 - protein, 517 aa, Brassica napus
MAMAMALRRLSSSVDKPIRPLIRSSSCYMSSLPSEAVDDKERSRVTWPKQLNASLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGFIDYDQMEKSATLFRPKLIVAGASAYARLYDYARIRKVCNKQKAVMLADMAHISGLVAAGVIPSPFEYADVVTTTTHKSLRGPRGAMIFYRKGVKEINKQGKEVMYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVKLALKVKSEAQGTKLKDFVSAMESSSAIQSEIAKLRHDVEEFAKQFPTIGFEKETMKYKN

SEQ ID NO: 125 - DNA, 1845 bp, Brassica napus
  CDS (148)..(1701)
gccaaaagcagaggccaaaattctctctgtcatctctccacaggataaacccactagtcttttttttttctctcgttcatgattcaaatctatctctagggtgtttccaaagagagagggagctaggcagagagaggttcagcgaaaatggcgatggccatggctcttcggagactttcttcttcagttgacaaacctattcgtcctcttatcagatcaactacatgctacatgtcatctctgcccagtgaagctgttgatgacaaggagagatctcgtgtcacttggccaaaacagcttaacgcatctttggaggaggttgatcctgagattgctgacattattgagcatgagaaagctagacaatggaagggacttgaactcattccatctgagaatttcacatctgtctcggtgatgcaagctgttggctctgtgatgactaacaagtacagtgaagggtaccctggtgctagatactatggaggaaatgagtacatagacatggcagagactttatgccaaaagcgcgctcttgaggctttcagattagatcctgaaaagtggggagtgaatgtgcaacccttgtctggatctcctgccaacttccatgtctacactgcattgctcaaacctcatgagagaatcatggcacttgatcttcctcatggtggtcatctttctcatggttatcagactgacaccaagaagatatctgctgtgtctatcttctttgagacaatgccttatcgcttggacgagagcactggctacattgactatgatcagatggagaaaagtgctactcttttcaggccaaaactgattgttgctggtgcgagtgcttatgctcgattgtatgactatgcccgcatccgaaaggtgtgtaacaagcaaaaagctgtgatgctagcagatatggcacacatcagtggtttggttgctgctggtgtaatcccttcaccgttcgactatgcagatgttgtgaccaccacaactcacaagtcacttcgtggaccccgtggagccatgattttctacagaaagggtgttaaggaaattaacaaacaagggaaagaggttttgtatgattttgaagacaagataaatcaagctgtcttccctggtcttcaaggtggtccacataaccacactattacaggactagctgttgctttaaaacaggcaactacttcagagtacaaagcataccaagagcaagtcctcagtaactctgcaaagtttgctcagactctgatggagaaaggttatgaacttgtttctggtggaactgacaaccatctggttctagtgaacctgaagcccaagggaattgatggatctagagttgagaaagtgttggaagctgttcacattgcatccaacaaaaacactgttcctggagatgtttctgccatggttcctggtggaatcagaatgggtacacctgctctcacttccagaggctttgttgaggaagactttgctaaagtagctgaatactttgacaaagctgtaacgttggctctcaaagtcaaatctgaagctcaagggaccaagctgaaagactttgtgtcagcaatggaagcttcttcaaccattcaatcagagattgctaagctgcgccatgaagttgaggaatttgctaaacagtttccaacaattgggtttgagaaagaaaccatgaagtacaagaactaaatgttttatcctacaagtctttttattatgctttgaacttccatggaatgtatagatgataataatccacgtacactctaaactctgtcttatgctatgagaaaaaaataatgggcgttctatgcaagaaaaaaaaaaaaaaaa

SEQ ID NO: 126 - protein, 517 aa, Brassica napus
MAMAMALRRLSSSVDKPIRPLIRSTTCYMSSLPSEAVDDKERSRVTWPKQLNASLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAAGVIPSPFDYADVVTTTTHKSLRGPRGAMIFYRKGVKEINKQGKEVLYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVTLALKVKSEAQGTKLKDFVSAMEASSTIQSEIAKLRHEVEEFAKQFPTIGFEKETMKYKN

SEQ ID NO: 127 - DNA, 1846 bp, Brassica napus
  CDS (146)..(1699)
gccaaaagcagaggccaaaattctctctgtcatctctccacaggataaacccactagtcttttttttttctctcgttcatgattcaaatctatctctagggtttccaaagagagagggagctaggcagagagaggttcagcgaaaatggcgatggccatggctcttcggcgactttcttcttcagttgacaaacctattcgtcctcttatcagatcaactacatgctacatgtcatctctgcccagtgaagctgttgatgacaaggagagatctcgtgtcacttggccaaaaaagcttaacgcatctttggaggaggttgatcctgagattgctgacattattgagcatgagaaagctagacaatggaagggacttgaactcattccatctgagaatttcacatctgtctcggtgatgcaagctgttggctctgtgatgactaacaagtacagtgaagggcaccctggtgctagatactatggaggaaatgagtacatagacatggcagagactttatgccaaaagcgcgctcttgaggctttcagattagatcctgaaaagtggggagtgaatgtgcaacccttgtctggatctcctgccaacttccatgtctacactgcattgctcaaacctcatgagagaatcatggcacttgatcttcctcatggtggtcatctttctcatggttatcagactgacaccaagaagatatctgctgtgtctatcttctttgagacaatgccttatcgcttggacgagagcactggctacattgactatgatcagatggagaaaagtgctactcttttcaggccaaaactgattgttgctggtgcgagtgcttatgctcgattgtatgactatgcccgcatccgaaaggtgtgtaacaagcaaaaagctgtgatgctagcagatatggcacacatcagtggtttggttgctgctggtgtaatcccttcaccgttcgactatgcagatgttgtgaccaccacaactcacaagtcacttcgtggaccccgtggagccgtgattttctacagaaagggtgttaaagaaattaacaaacaagggaaagaggttttgtatgattttgaagacaagataaatcaagccgtcttccctggtcttcaaggtggtccacataaccacactattacaggactagctgttgctttaaaacaggcaactacttcagagtacaaagcataccaagagcaagtcctgagcaactctgcaaagttcgctcagactctgatggagaaaggttatgaacttgtttctggtggaaccgacaaccatctggttctagtgaacctgaagcccaagggaattgatggatctagagttgagaaagtgttggaagctgttcacattgcatcaaacaaaaacactgttcctggagatgtttctgccatggttcctggtggaatcagaatgggtacacctgctctcacttccagaggctttgttgaggaagactttgctaaagtagctgaatactttgacaaagctgtaacgttggctctcaaagtcaaatctgaagctcaagggaccaagctgaaagactttgtgtcagcaatggaagcttcttcaaccattcaatcagagattgctaagctgcgccatgaagttgaggaatttgctaaacagtttccaacaattgggtttgagaaagaaaccatgaagtacaagaactaaatgttttatcctacaagtctttttttattatgctttgaacttccatggaatgtatagatgataataatccacgtacactctaaactctgtcttatgctatgagaaaaaataatgaacgttctatgcaaatcgaaaaaaaaaaaaaaa

SEQ ID NO: 128 - protein, 517 aa, Brassica napus
MAMAMALRRLSSSVDKPIRPLIRSTTCYMSSLPSEAVDDKERSRVTWPKKLNASLEEVDPEIADIIEHEKARQWKGLELIPSENFTSVSVMQAVGSVMTNKYSEGHPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAAGVIPSPFDYADVVTTTTHKSLRGPRGAVIFYRKGVKEINKQGKEVLYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVTLALKVKSEAQGTKLKDFVSAMEASSTIQSEIAKLRHEVEEFAKQFPTIGFEKETMKYKN

SEQ ID NO: 129 - DNA, 1145 bp, Linum usitatissimum
  CDS (62)..(1003)
  misc_feature (940)..(1037): Each n is a, c, g, or t
cctcaaactcccccaatcctctgtttccttttctctctctctctctctgaatctcagcaaaatggatccagtcaaggtatggggaaacactcctttgcaaaccgtggaccctgagatccacgacctcatcgagaaggagaagcgccgtcaatgccgcgggatcgagctcatcgcctccgagaacttcacctccttcgccgtcatcgaagccctcggcagcgccctcaccaacaagtactccgagggcatgcccggaaatcgctactacggcggcaacgagtacatcgatcagatcgagaacctctgcgtatcccgcgccttgaccgctttccacttggacgacaccaagtggggcgtcaatgtccagccttactccggctcccctgccaatttcgccgcctacaccgccattctcaagccccatgatcgtatcatgggattggatctcccatctggtggtcatctgactcatggatactacacctccagcgggaagaagatctccgccacttccatctacttcgagagcttgccttacaaggtgaattccagcactggctacatcgactacgataagctggaagagaaggctttggatttcaggccacggttgatcatctgtggtggcagtgcttaccctagggactgggattacgctaggttcagggctattgctgataaatgcggcgcacttttgctctgcgatatggctcacattagcggcctagttgctgctcaggaagctgccaacccctttgagttctgtgacattgtcacaaccaccacccacaagagtttgaggggtcccagagctggtatgatcttctaccgcaagagacctaagccagccaacaagaagggtcagcctcagggaaactatgaattcgaggacaacatcaacttctctgtcttccctgccctccagggagcccccataatcaccagatcggtgcccttgctgttgcattgnaagcaaggctgcaacccctgcattcaagcctaacccaagcaatngaagcncaagctgttgctgttgngaaactatttgatgagcaaaggctacaccttggttactggaggaactgagaaccaccttgttctgtgggatctgagacctcttgggttgactggcaacaaggtcgaga

SEQ ID NO: 130 - protein, 313 aa, Linum usitatissimum
  misc_feature (303)..(303): The 'Xaa' at location 303 stands for Trp, or Cys.
MDPVKVWGNTPLQTVDPEIHDLIEKEKRRQCRGIELIASENFTSFAVIEALGSALTNKYSEGMPGNRYYGGNEYIDQIENLCVSRALTAFHLDDTKWGVNVQPYSGSPANFAAYTAILKPHDRIMGLDLPSGGHLTHGYYTSSGKKISATSIYFESLPYKVNSSTGYIDYDKLEEKALDFRPRLIICGGSAYPRDWDYARFRAIADKCGALLLCDMAHISGLVAAQEAANPFEFCDIVTTTTHKSLRGPRAGMIFYRKRPKPANKKGQPQGNYEFEDNINFSVFPALQGAPIITRSVPLLLHXKQGCNPCIQA

SEQ ID NO: 131 - DNA, 1824 bp, Zea mays
  CDS (105)..(1520)
ggtcgacttcgctgtcgacgatttcgttccgcccccgcccccgcccacgcccactcctcgctgccaccactcctgtcacctcttcccgcgccgacgcagccgccatggaccccgtcgccacatgggggctaaccccgcccgcgggcgccgacccggagatctacgacctcctggagcgcgagaagcggcgccagcgtcgcggcatcgagctcatcgcctccgagaacttcacctccttcgccgtcatggaagcgctcggctccgcgctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtagatatgcctctttcatgcgcggcaaggtcctcctgtaccgatgtctttccttgtggtggcgcagggtgccatggcactgcattgccgccacacttacgatgatgatgatgggttatggattttgtctacaatgtcagcaggataggctcacaattgccccctgccctccggtttggtcgcctctcaggttttcatttggtagttgttcgcagggaaccatatgagaattgcaatgtcaatcaggtgtttgccaataataattgggtggtttctgctcttgctctggccaaaaaaaaaaaaaaaaa

SEQ ID NO: 132 - protein, 471 aa, Zea mays
MDPVATWGLTPPAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 133 - DNA, 1748 bp, Glycine max
  CDS (91)..(1503)
cggtcgacgatttcgtcacaacaacactctctcttctcgctcttggcttttcgctcttcactcactctcattcattcatttccaccgttcatggatccagtaagcgtgtggggtaacacgcccttggcgacggtggatcccgagatccatgacctcatcgagaaggagaagcgccgtcaatgccgcggaatcgagctcatcgcctccgagaacttcacctccttcgccgtcatcgaggccctcggcagcgctctcacgaacaaatactccgagggcatgccgggcaaccgctactacggcggcaatgaatacatcgaccagatcgaaaacctctgccgctcacgcgccctccaagccttccacctcgacgcccaatcctggggcgtcaacgtccagccctactccggctccccggccaacttcgccgcctacaccgccgtcctcaacccccacgaccgcatcatggggctagatctcccctccggcggccacctcacccacggctactacacctccggcggaaagaagatctccgccacctccatttacttcgagagcctcccttacaaggtaaactccaccaccggctacatcgactacgaccgcttggaagaaaaagccctagacttcaggccaaaactcataatctgcggtggcagcgcgtaccctcgcgattgggactacaaacgtttcagggaagtcgctgataagtgcggagcattgcttctctgcgacatggcgcacactagcggccttgtggccgcgcaggaagtgaacagccccttcgagtattgcgacattgtgaccaccacgactcacaagagcttgcggggcccacgtgcggggatgatcttttaccggaagggccccaagccgccgaagaaggggcagccggagaacgcggtttatgatttcgaggacaagattaacttcgcggtgttcccttcgctgcagggtgggccccacaaccaccagatcggtgctctcgccgtggcgctgaagcaggccgcgtcgcccgggtttaaggcctacgcgaagcaggttaaggcgaacgccgttgcgcttggaaaatacttgatggggaaagggtacagccttgtcactggcggaacggagaaccatcttgttttgtgggatctgagacctcttggattgactgggaataaggtggagaaactctgtgatctctgtaacattactgttaacaagaacgctgtttttggtgatagcagtgccttggcccctggtggagtgcgaattggtgcccctgccatgacttctaggggtttggttgaaaaagactttgagcagattggtgagttccttcaccgtgctgtgactctcacactggagatccagaaggagcatggcaaacttctcaaggatttcaacaagggtctcgtcaacaacaaggctattgaagatctcaaagctgatgttgagaagttctctgccttgtttgacatgcctggcttcctggtatctgaaatgaagtacaaggattaggttcaaccataccactttctactaaattgtgtcactcaagttcgacacaaagtgcagaaatggagaaaaaggaaatatgtgtcttcctttcctgggagtgatagggtttatcgccatggtgtttcaattcaaaagtttgaagtttctttgtctttgatttcatgtttaattttgttagcctgattgatatcatattttttttcttatttaacaattgaaataatacgtgctgcctttctttc

SEQ ID NO: 134 - protein, 471 aa, Glycine max
MDPVSVWGNTPLATVDPEIHDLIEKEKRRQCRGIELIASENFTSFAVIEALGSALTNKYSEGMPGNRYYGGNEYIDQIENLCRSRALQAFHLDAQSWGVNVQPYSGSPANFAAYTAVLNPHDRIMGLDLPSGGHLTHGYYTSGGKKISATSIYFESLPYKVNSTTGYIDYDRLEEKALDFRPKLIICGGSAYPRDWDYKRFREVADKCGALLLCDMAHTSGLVAAQEVNSPFEYCDIVTTTTHKSLRGPRAGMIFYRKGPKPPKKGQPENAVYDFEDKINFAVFPSLQGGPHNHQIGALAVALKQAASPGFKAYAKQVKANAVALGKYLMGKGYSLVTGGTENHLVLWDLRPLGLTGNKVEKLCDLCNITVNKNAVFGDSSALAPGGVRIGAPAMTSRGLVEKDFEQIGEFLHRAVTLTLEIQKEHGKLLKDFNKGLVNNKAIEDLKADVEKFSALFDMPGFLVSEMKYKD

SEQ ID NO: 135 - DNA, 1655 bp, Brassica napus
  CDS (21)..(1433)
ctcactcactcattctcaccatggatccagtctcatcctggggaaacacccctctcgtcacggtcgatcccgagatccacgacctcatcgagaaggagaaacgccgccagtgccgcggaatcgaactcatcgcctccgagaatttcacctccttcgccgtcatcgaagctctcggaagcgcgctgaccaacaaatactccgaaggcatgcccggtaaccgttactacggaggcaacgagttcatcgaccagatcgagaacctctgccagtcacgcgctctcgaagccttccgtctcgagtcagcatcctggggcgtcaatgtgcagccctactccggatctccggccaacttcgccgcttacaccgccttgcttcagcctcacgatcgaatcatggggcttgatctgccgtcgggtggtcatctcacgcatggatactacacatccggagggaagaagatctctgctacttccatctactttgagagccttccttataaggtgaacttcaccactggttacatcgattacgataagcttgaggagaaggccatggatttcaggcctaagttgctcatctgtggcggtagtgcctaccctagggactgggattacgctagattgagagccgttgctgataaggttggagctcttttgctctgtgacatggctcacattagtggcctcgttgctgctcaggaagctgcaaacccatttgagtactgtgacgttgtgacaacaacaacccacaagagtttgaggggtccaagggctggtatgatcttctacaggaagggcccaaaaccaccaaagaagggacaacccgagggtgcagtctatgactttgaggacaaaatcaactttgctgtgttccctgcgcttcaaggtggtcctcacaaccaccagatcggtgctctagctgttgcgttgaagcaggctaacactcctggtttcaaggtctatgcgaaacaggtgaaagccaatgctgttgcccttgcaaactacctgatgggtaagggatacagtattgtaaccggtggaactgagaaccaccttgttctttgggatcttcgccctcttggattgaccggtaacaaggttgagaagctttgcgatctgtgcaacattactttgaacaagaatgctgtctttggagacagcagtgctcttgctcctggaggtgtaagaatcggtactcctgcgatgacatcaaggggattggtggagaaggactttgagatgataggagagttcttgagccgatcagtgacactgacattgaacatccagaaggagcatggtaaactgttgaaggactttaacaagggtttggtgaacaacaaagagatcgaggagctcaaggctgatgtcgagaagttctcagcctcctatgagatgcctggattcctcatgtctgcgatgaagtaccaggattagagatttcctctctctatcaaagagtaatcttttattatctctatatataatatgcttttgtagggccgcctgattggaattcacaaggcgaagagatgaagaaacaaacagtaaaatacaaaaagggttttttttttgagtaatttcttcttgaatgtttttattttatcttattgaaattgttgtattttgttggctttttaataatatcaagcgagt

SEQ ID NO: 136 - protein, 471 aa, Brassica napus
MDPVSSWGNTPLVTVDPEIHDLIEKEKRRQCRGIELIASENFTSFAVIEALGSALTNKYSEGMPGNRYYGGNEFIDQIENLCQSRALEAFRLESASWGVNVQPYSGSPANFAAYTALLQPHDRIMGLDLPSGGHLTHGYYTSGGKKISATSIYFESLPYKVNFTTGYIDYDKLEEKAMDFRPKLLICGGSAYPRDWDYARLRAVADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALANYLMGKGYSIVTGGTENHLVLWDLRPLGLTGNKVEKLCDLCNITLNKNAVFGDSSALAPGGVRIGTPAMTSRGLVEKDFEMIGEFLSRSVTLTLNIQKEHGKLLKDFNKGLVNNKEIEELKADVEKFSASYEMPGFLMSAMKYQD

SEQ ID NO: 137 - DNA, 1711 bp, Zea mays
  CDS (11)..(1282)
cttcgccgtcatggaggcgctcggctccgggctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtagacatgcctcccatgcgcggcaaggtcctcctgtaccgatgtctttccttgtggtggcgcagggtgccatggcactgcattgccgccacacttacgatgatgatgatgggttatggattttgtctacaatgtcagcaggataggctcacaattgccccctgccctccggtttggtcgcctctcaggttttcatttggtagttgttcgcagggaaccatatgagaattgcaatgtcaatcaggtgtttgccaataataattgggtggtttctgctcttgctctggtcattaccatgcattttttattctgttggtgagttggtcgatttattatctcctgcagtcctgctggcactgccggtggtcgtttgattatcatgtatgaatcttcctggagactgttgctcgattaacatatcgcctgctcc

SEQ ID NO: 138 - protein, 424 aa, Zea mays
MEALGSGLTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 139 - DNA, 1845 bp, Helianthus annuus
  CDS (348)..(1760)
aatctcccctctctccacgacaatttcgacacccattttccacacatcactcaagtacctggtgttaaccttttggtctgcgtcaaacgggtggcatagcatcggaaccccttcagacatgctttccaatgtcgaattccaaccgcaatggctccaaaatcctccaattgcagaatgtgccaagacttccttctgcggtgcccatttcacgatcaaacctctcgccttcatctcactcaccaaaccctccggcaaaaactcaatccattcaaaccctttaaccgaaccgggtcgaaccacccccaacaacctctcctctctctatactctactctctctagaccagcatggatcccgttaatgtgtggggcaacacccccctagacgccgccgacccagagatcttcgacctcattgagaaagaaaaacgccgccaatgtcgcggaatcgaactgattgcatccgaaaacttcacctcatttgcagtcatccaagctttgggatcccccttgaccaacaaatactccgagggcatgcctggaaaccgttactacggtggcaacgagtacatcgaccagatcgaaaacctctgccgttctcgcgccttacaggcttaccgtctagatcccaccaaatggggtgttaatgtccagccctattctggatctcctgccaattttgctgcctatacagccctcttagagccccatgatcggatcatgggccttgatttgccatcaggtgggcatttgacgcatggatattatacttccggtgggaagaagatatcagctacctcgatttactttgagagtttgccgtataaagtgaattcgactacgggatatatcgattacgagaagatggaggagaaggccttggactttagacccaagttgattatttgtggggggagtgcgtacccgagagattgggattacaagaggatcaggggcattgctgataaatgtggggccctcatgttgtgtgatatggctcatatcagtggccttgttgctgcacaggaagctgcagatccgttcgaatactgtgacgtggtcactaccaccacccacaagagtctcaggggaccaagagctggtatgatcttctaccgcaaaggtccaaaaccaccgaagaagggtcagccagaagatgctgtttatgactttgaagacaagatcaattttgctgtgttcccggctctgcaaggtgggccgcacaaccaccagattggtgctctagcggttgcgttgaaacaggccatgtcacctggattcaaggcatatgctaagcaagttagagccaatgctgttgcacttggtaactacttgatgagcaaagactacaagcttgtgaccggtggaactgaaaaccatcttgtgttgtgggatcttcgtcctcttggcttgaccgggaacaaggtggagaagctttgcgatcttgcaaacatcactgttaacaagaatgctgtgtttggtgacagcagtgctttggccccaggaggtgttcgtattggtacacctgcaatgacctcaaggggtttagttgagaaggattttgagcaaattggggagtttcttcaccgtgcaattcaaatcactttaagcatccagaaggagttcgggaaattattgaaggatttcaacaagggtttggtgaacaacaaggagatcgaacaactcaaggctgatgtcgagaagttttctggttcgtttgacatgcctgggttctcgttggccgacatgaagtataaggattgagaagatgaagagatctatgtaatgaatgatgtttgtgttgttattagtaacattttctggtgtttgttttgatgtctagtac

SEQ ID NO: 140 - protein, 471 aa, Helianthus annuus
MDPVNVWGNTPLDAADPEIFDLIEKEKRRQCRGIELIASENFTSFAVIQALGSPLTNKYSEGMPGNRYYGGNEYIDQIENLCRSRALQAYRLDPTKWGVNVQPYSGSPANFAAYTALLEPHDRIMGLDLPSGGHLTHGYYTSGGKKISATSIYFESLPYKVNSTTGYIDYEKMEEKALDFRPKLIICGGSAYPRDWDYKRIRGIADKCGALMLCDMAHISGLVAAQEAADPFEYCDVVTTTTHKSLRGPRAGMIFYRKGPKPPKKGQPEDAVYDFEDKINFAVFPALQGGPHNHQIGALAVALKQAMSPGFKAYAKQVRANAVALGNYLMSKDYKLVTGGTENHLVLWDLRPLGLTGNKVEKLCDLANITVNKNAVFGDSSALAPGGVRIGTPAMTSRGLVEKDFEQIGEFLHRAIQITLSIQKEFGKLLKDFNKGLVNNKEIEQLKADVEKFSGSFDMPGFSLADMKYKD

SEQ ID NO: 141 - DNA, 2228 bp, Oryza sativa
  CDS (43)..(1581)
cccccgcctccaccaccacccgccgctcgccgctcgcccaccatggccatggcgacggcgctccgcaagctctcctccgacgccctccgccgccagccgctctcccgcatcaccccgctctactacatggcgtccctgccggcgacggaggagagatccggagtcacctggccgaagcagctgaacgcgccgctggaggaggtggatcccgagatcgccgacatcatcgagcacgagaaggcccgccaatggaagggtctggagctcatcccgtcggagaacttcacctcggtgtcagtgatgcaggcggtgggatccgtcatgaccaacaagtacagcgaggggtaccccggcgcgagatactacggtggaaacgaatacattgatatggccgagtcattgtgccagaaacgtgctttggaggccttccgcttggacccagcgaaatggggagtgaatgtgcaacctctatcagggtcacctgccaacttccatgtttacactgccctattgaaaccacatgagagaatcatggctttggatcttcctcatggtggacatctttctcacggctaccagactgatactaagaagatttcagcagtttcgatattctttgagacaatgccctacagattggatgaaagcactggcttgattgattatgatcagatggagaaaagtgccgttctttttaggccaaagttgatcgttgcgggtgcaagtgcatatgcgcgtctttatgactatgaccgcatgcggaaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggttatgtatgactttgaggacaagatcaatgctgctgtcttcccaggtctgcaaggtggaccacataatcataccattactggcttagctgttgcgcttaagcaggcaactactccggagtacagagcttatcaagagcaagttatgagtaactgtgcaaaatttgcacagagcttgacagcaaaaggctacgaacttgtctctggtgggactgacaaccatttagtgttggtaaatctcaagagcaagggcatagatggttcaagagtggagaaggttttagaaaacgtgcacattgcagcaaacaagaacacagttcctggtgatgtttcagctatggtaccaggaggcatcaggatgggaaccccagcactgacctcaagaggatttgttgaggaggactttgctaaggttgctgatttcttcgatgcagcagtgaacttggctttgaaggttaaggctgcagcaggtggaacaaaactgaaggactttgttgccactttgcaatctgatagcaacattcaatccgagattgcaaaacttcgccatgatgtggaggaatatgcaaaacagttccccacaattgggtttgagaaagaaaccatgaagtacaagaactaagaaactttgaatggaacagcaagggtaaaagaaaaggcatcaagctgaattcctgaggtgactgttggaattcttgcaagaacaagtcggtgtaaacatatatccatggagtgccatcttatgtaaaagggacccctggcattttacagcgtgtggaaactttgtcaatagttcttatcgtagacacctactgtaagatgttatgctaatgctatattaaccttcactatcttcttggacaagcagttacacatactttggtgtattctgtgaataattcgcatgattgcggaatttttcgtgtttataaatcgtaacttgtaatcttttggccctgcacgcaatttgaaagccctcgatcggattgtcgtttactgcacacaactgtgaaaaaaaaaggcatatgataactgtggacaaaggctaccaagggcaatgggattttttttaccttttacctttttaatcttagaaataaactccttcaaaatttattttgaagatctgaattttttttgacaccgatctggttggcgtgttagcattgtcttgccatgccacctggctgatgtgataggacgttcgttgcaggtgatgtgccagcgttgtattactcttttggaaataagttttgaaagtattta

SEQ ID NO: 142 - protein, 513 aa, Oryza sativa; identical to SEQ ID NO: 122

SEQ ID NO: 143 - DNA, 1943 bp, Hordeum vulgare
  CDS (56)..(1585)
gctccaacccctacccagaaggagaggaggaggccgcccaccaccaccacccaccatggccatggcgacggcgctccgcaagctctccgcccgcggtcagcccctctcccgactcacgccgctctactccatggcgtccctgccggcgacggaggagagatccgcagtcacctggccgaagcagctcaacgcgccgctggaggaggtcgacccggagattgccgacatcatcgagctcgagaaggcccgccaatggaaggggctggagctcatcccgtcggagaacttcacctccctgtcggtgatgcaggccgtgggatccgtcatgacgaacaagtacagcgaggggtaccccggcgccagatactacggtggaaacgaatacattgatatggccgagacgctgtgccagaaacgtgctttggaggccttcaatttggacccggagaagtggggagtgaatgtgcaacctctgtcgggttcacctgccaacttccatgtatacactgctctgctgaagccacatgacagaattatggccctggatcttcctcacggtggacatctttcccatggttaccagactgacacaaagaaaatctcagcagtttcaatattctttgagacaatgccttacagactggatgaaagcactggcttgattgattatgaccagttggagaaaagtgccgttctttttaggccaaagttgattgttgctggtgctagtgcatatgctcgcctttatgattataaccgcatgcggaagatctgtgacaagcagaaggcagttcttctcgcagacatggcacatatcagtgggctagttgctgctggtgtcattccctctccttttgagtatgccgatgtggtgactaccactacccacaagtcactccgtggtccacgtggagccatgatctttttccggaagggggtgaaagaaataaacaaacaagggaaggaggttaagtatgattttgaggacaaaatcaatgctgctgtcttccctggtctgcaaggtggaccacataaccatactattactggcctggccgttgcgcttaagcaggcaactactcaggagtaccgagcttatcaagagcaagttatgagcaactctgctagatttgctgagagcttgacttccaaaggctacgacattgtctctggtgggactgataaccatttagttttggtgaacctcaagaaaaagggaatagatggttcaagagtggagaaggttttagaaaatgtgcatattgcagcaaacaagaacacagttcctggtgatgtttcagctatggtacccggaggcatcaggatgggaacccccgcgcttacatcaagaggatttgttgaggaggacttcgccaaggttgccgaattcttcgattcggcagtgaacttggctttgaaggttaaagctgcagcagcaggtaccaaactgaaggactttgttgccactttgcaatccgacagcaacatccaagctgaaattgcaaagcttcgccacgatgtggaggaatatgcaaaacaattcccaacaatcggattcgagaaagagaccatgaagtacaagaactaagcactgctgtgtttcaacagcaaggaagcaaacaggaagcacaactgaggacaagtccatgtaaacaatagatccatgatgaagcgccatcttatgtaaaaggaatccaagcattttacagaatatgggaactttgtcaatagtttcttattgcaggcacatactgtaagatgtttcgctgatatgctatatgaaccaccatccttcttggataagcatttacttacacaaaaaaaaaaaaaagctccgtggataacacgtatgattcggctttgagatcttgagcggtttgtgagcttcatgtatggacattatctttgtgatgaaattcctgccataaaaaaaaaaaaaaaaa

SEQ ID NO: 144 - protein, 510 aa, Hordeum vulgare
MAMATALRKLSARGQPLSRLTPLYSMASLPATEERSAVTWPKQLNAPLEEVDPEIADIIELEKARQWKGLELIPSENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHGYQTDTKKISAVSIFFETMPYRLDESTGLIDYDQLEKSAVLFRPKLIVAGASAYARLYDYNRMRKICDKQKAVLLADMAHISGLVAAGVIPSPFEYADVVTTTTHKSLRGPRGAMIFFRKGVKEINKQGKEVKYDFEDKINAAVFPGLQGGPHNHTITGLAVALKQATTQEYRAYQEQVMSNSARFAESLTSKGYDIVSGGTDNHLVLVNLKKKGIDGSRVEKVLENVHIAANKNTVPGDVSAMVPGGIRMGTPALTSRGFVEEDFAKVAEFFDSAVNLALKVKAAAAGTKLKDFVATLQSDSNIQAEIAKLRHDVEEYAKQFPTIGFEKETMKYKN

SEQ ID NO: 145 - DNA, 1800 bp, Arabidopsis thaliana
  CDS (64)..(1473)
gatctcagatctctccctccctctttctccgatctcagatccattcaacaatctccaaagaagatggaaccagtctcttcatggggtaacacctctctcgtctccgtagatccagagatccacgacctaatcgagaaggagaaacgtcggcaatgtcgaggaatcgaacttatcgcttccgagaatttcacttccttcgccgtcatcgaagctctcggaagtgccttaaccaacaaatactccgaaggtattcctggtaatcgttattacggaggtaacgaattcatcgatgagatcgagaatctttgccgttcaagagctctcgaagctttccattgtgatccagcagcgtggggcgttaatgttcagccgtattctggatctccggcaaatttcgctgcttacacggctttgcttcagcctcacgatcgtatcatggggcttgatttgccttcaggtggtcatttgactcatggttactatacatctggtggtaagaagatctctgcgacttcgatctactttgagagtcttccgtataaggtgaatttcaccactggttacattgattacgataagcttgaagagaaggcgttggatttcaggcctaagttgcttatctgtggtggtagtgcgtatcctagggattgggattacgctagatttagagctattgctgataaggttggagctcttttgctttgtgacatggctcacatcagtggtctcgttgctgctcaggaagctgcaaacccatttgagtactgtgacgttgtgacaaccacaacccacaagagtttgaggggtccaagggctggtatgattttctacaggaagggtccaaaaccaccaaagaagggtcaacccgagggtgcagtctatgattttgaggacaaaatcaactttgctgtattccctgcgcttcaaggtggtcctcacaatcaccagattggtgctctagctgttgcgttgaagcaggctaatactcctgggttcaaggtctacgcaaaacaagtgaaagccaatgctgttgcccttggaaactacctaatgagcaagggttaccagattgtgaccaatggaactgagaaccaccttgttctctgggatcttcgccctcttggattgaccggaaacaaggttgagaagctctgcgatctgtgcagcattacattgaacaagaacgcagtatttggagacagtagtgctcttgctcctggaggtgtaagaatcggtgcacccgcgatgacatcgagaggattggtggagaaggactttgagcagataggagaattcctgagccgtgcagtgacactgacgttggacatccaaaagacatacggtaagttgttgaaggacttcaacaagggtttggtgaacaacaaagatctcgatcagctcaaggctgatgtcgagaagttctcggcgtcttatgagatgcctggattcctcatgtctgagatgaagtacaaggattagagatctttctctatatgcaagagtaatcttctattattatctaccatatatataaaatatgcttttgtaggatcgccttaaaggcgaagagatgaagatgcaaacagtaaaaaaaaagggttttcttttcagctatttcttcttgaatgttttttttctttttcttttggtttcttattgaaattgttgtatttttgttggcttttttctaataatatcagcgagtttttctttccactgtttcaattaaatacggtgtgtttgtatgggttttagtttcatagattgaattatttgtactcaactaaggaattcgtgtaa

SEQ ID NO: 146 - protein, 470 aa, Arabidopsis thaliana
MEPVSSWGNTSLVSVDPEIHDLIEKEKRRQCRGIELIASENFTSFAVIEALGSALTNKYSEGIPGNRYYGGNEFIDEIENLCRSRALEAFHCDPAAWGVNVQPYSGSPANFAAYTALLQPHDRIMGLDLPSGGHLTHGYYTSGGKKISATSIYFESLPYKVNFTTGYIDYDKLEEKALDFRPKLLICGGSAYPRDWDYARFRAIADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALGNYLMSKGYQIVTNGTENHLVLWDLRPLGLTGNKVEKLCDLCSITLNKNAVFGDSSALAPGGVRIGAPAMTSRGLVEKDFEQIGEFLSRAVTLTLDIQKTYGKLLKDFNKGLVNNKDLDQLKADVEKFSASYEMPGFLMSEMKYK

SEQ ID NO: 147 - DNA, 664 bp, Brassica napus
  CDS (88)..(570)
attcccgggtcgactccatctccatcttcttagctacctcgtcctgaaagctcaaacatttatccacagtaccggactagagaaagaatggaagcttgttgtggagctacttcaatgggttctcttcagcaatctggaggggttaaaggacctgtctttgctccagtaatgtccccagtgaacaagttttctcagcaactgaagttcaattttgccggacctaaccgttctctgtttctaaaagaagcctggtcgttgaaaggaaagcgtctcaagtctcggtacctgccgtcgagactagcagcaatgaaatcccttttgaggactatggccgtactgaagttgatccagaggtcgatgagattatcaaaaaggagaaaaacagacagttcaggagcttggagctcattgcctccgagaatttcacgtctcgtgctgttatggagactgttggatcatgccttaccaacaagtattctgagggacttcctggtaaaaggtattatggtggcaatgagttcatcgatcagctggagacactttgccagaaccgggccttagcgaccttccgcttagattcaaccaaatggggagttaacgttcagcccttatctggttcacctgcaaactttgctgtgtacactgccatacttaagcctcatga

SEQ ID NO: 148 - protein, 157 aa, Brassica napus
MEACCGATSMGSLQQSGGVKGPVFAPVMSPVNKFSQQLKFNFAGPNRSLFLKEAWSLKGKRLKSRYLPSRLAAMKSLLRTMAVLKLIQRSMRLSKRRKTDSSGAWSSLPPRISRLVLLWRLLDHALPTSILRDFLVKGIMVAMSSSISWRHFARTGP

SEQ ID NO: 149 - DNA, 1186 bp, Linum usitatissimum
  CDS (103)..(1041)
  misc_feature (1011)..(1078): Each n is a, c,g, or t
ttgtaccaaaaagcaggctggtaccggtccggaattcccgggatcaaactcccccaatcctctgtttccttttctctctctctctctctgaatctcagcaaaatggatccagtcaaggtatggggaaacactcctttgcaaaccgtggaccctgagatccacgacctcatcgagaaggagaagcgccgtcaatgccgcgggatcgagctcatcgcctccgagaacttcacctccttcgccgtcatcgaagccctcggcagcgccctcaccaacaagtactccgagggcatgcccggaaatcgctactacggcggcaacgagtacatcgatcagatcgagaacctctgcgtatcccgcgccttgaccgctttccacttggacgacaccaagtggggcgtcaatgtccagccttactccggctcccctgccaatttcgccgcctacaccgccattctcaagccccatgatcgtatcatgggattggatctcccatctggtggtcatctgactcatggatactacacctccagcgggaagaagatctccgccacttccatctacttcgagagcttgccttacaaggtgaattccagcactggctacatcgactacgataagctggaagagaaggctttggatttcaggccacggttgatcatctgtggtggcagtgcttaccctagggactgggattacgctaggttcagggctattgctgataaatgcggcgcacttttgctctgcgatatggctcacattagcggcctagttgctgctcaggaagctgccaacccctttgagttctgtgacattgtcacaaccaccacccacaagagtttgaggggtcccagagctggtatgatcttctaccgcaagagacctaagccagccaacaagaagggtcagcctcagggaaactatgaattcgaggacaacatcaacttctctgtcttccctgccctccagggagcccccataatcaccagatcggtgcccttgctgttgcattgnaagcaaggctgcaacccctgcattcaagcctaacccaagcaatngaagcncaagctgttgctgttgngaaactatttgatgagcaaaggctacaccttggttactggaggaactgagaaccaccttgttctgtgggatctgagacctcttgggttgactggcaacaaggtcgaga

SEQ ID NO: 150 - protein, 313 aa, Linum usitatissimum; identical to SEQ ID NO: 130
  misc_feature (303)..(303): The 'Xaa' at location 303 stands for Trp, or Cys.

SEQ ID NO: 151 - DNA, 1844 bp, Helianthus annuus
  CDS (119)..(1759)
aatctcccctctctccacgacaatttcgacacccattttccacacatcactcaagtacctggtgttaaccttttggtctgcgtcaaacgggtggcatagcatcggaaccccttcagacatgctttccaatgtcgaattccaaccgcaatggctccaaaatcctccaattgcagaatgtgccaagacttccttctgcggtgcccatttcacgatcaaacctctcgccttcatctcactcaccaaaccctccggcaaaaactcaatccattcaaaccctttaaccgaaccgggtcgaaccacccccaacaacctctcctctctctatactctactctctctagaccgcatggatcccgttaatgtgtggggcaacacccccctagacgccgccgacccagagatcttcgacctcattgagaaagaaaaacgccgccaatgtcgcggaatcgaactgattgcatccgaaaacttcacctcatttgcagtcatccaagctttgggatcccccttgaccaacaaatactccgagggcatgcctggaaaccgttactacggtggcaacgagtacatcgaccagatcgaaaacctctgccgttctcgcgccttacaggcttaccgtctagatcccaccaaatggggtgttaatgtccagccctattctggatctcctgccaattttgctgcctatacagccctcttagagccccatgatcggatcatgggccttgatttgccatcaggtgggcatttgacgcatggatattatacttccggtgggaagaagatatcagctacctcgatttactttgagagtttgccgtataaagtgaattcgactacgggatatatcgattacgagaagatggaggagaaggccttggactttagacccaagttgattatttgtggggggagtgcgtacccgagagattgggattacaagaggatcaggggcattgctgataaatgtggggccctcatgttgtgtgatatggctcatatcagtggccttgttgctgcacaggaagctgcagatccgttcgaatactgtgacgtggtcactaccaccacccacaagagtctcaggggaccaagagctggtatgatcttctaccgcaaaggtccaaaaccaccgaagaagggtcagccagaagatgctgtttatgactttgaagacaagatcaattttgctgtgttcccggctctgcaaggtgggccgcacaaccaccagattggtgctctagcggttgcgttgaaacaggccatgtcacctggattcaaggcatatgctaagcaagttagagccaatgctgttgcacttggtaactacttgatgagcaaagactacaagcttgtgaccggtggaactgaaaaccatcttgtgttgtgggatcttcgtcctcttggcttgaccgggaacaaggtggagaagctttgcgatcttgcaaacatcactgttaacaagaatgctgtgtttggtgacagcagtgctttggccccaggaggtgttcgtattggtacacctgcaatgacctcaaggggtttagttgagaaggattttgagcaaattggggagtttcttcaccgtgcaattcaaatcactttaagcatccagaaggagttcgggaaattattgaaggatttcaacaagggtttggtgaacaacaaggagatcgaacaactcaaggctgatgtcgagaagttttctggttcgtttgacatgcctgggttctcgttggccgacatgaagtataaggattgagaagatgaagagatctatgtaatgaatgatgtttgtgttgttattagtaacattttctggtgtttgttttgatgtctagtac

SEQ ID NO: 152 - protein, 547 aa, Helianthus annuus
MLSNVEFQPQWLQNPPIAECAKTSFCGAHFTIKPLAFISLTKPSGKNSIHSNPLTEPGRTTPNNLSSLYTLLSLDRMDPVNVWGNTPLDAADPEIFDLIEKEKRRQCRGIELIASENFTSFAVIQALGSPLTNKYSEGMPGNRYYGGNEYIDQIENLCRSRALQAYRLDPTKWGVNVQPYSGSPANFAAYTALLEPHDRIMGLDLPSGGHLTHGYYTSGGKKISATSIYFESLPYKVNSTTGYIDYEKMEEKALDFRPKLIICGGSAYPRDWDYKRIRGIADKCGALMLCDMAHISGLVAAQEAADPFEYCDVVTTTTHKSLRGPRAGMIFYRKGPKPPKKGQPEDAVYDFEDKINFAVFPALQGGPHNHQIGALAVALKQAMSPGFKAYAKQVRANAVALGNYLMSKDYKLVTGGTENHLVLWDLRPLGLTGNKVEKLCDLANITVNKNAVFGDSSALAPGGVRIGTPAMTSRGLVEKDFEQIGEFLHRAIQITLSIQKEFGKLLKDFNKGLVNNKEIEQLKADVEKFSGSFDMPGFSLADMKYKD

SEQ ID NO: 153 - DNA, 1801 bp, Triticum aestivum
cccactggtgcctccccctctccactccccccctccgccgacgccccaccactccccccttcctcctcctcctccgccgccgccgccgcaatggactccgtcgcgtcgtgggggctgaccccgctggcggacgcggacccggacgtcttcgacctcatcgagcgggagaagcggcgccagcggagcgggatcgagctcatcgcctccgagaacttcacctccttcgccgtcatcgaggcgctcggctcggccctcaccaacaagtactccgagggcatgccgggggcgcgctactacggcggcaacgacgtcatcgacgagatcgagaacctctgccgcgaccgcgccctcgccgccttccgcctcgacgccgcctcctggggcgtcaacgtgcagccctactccggctcgcccgcaaacttcgccgcatacaccgcgctcctcaacccgcacgaccggatcatggggctcgacctcccctcaggcggacacctcacccacggctactacaccgccggggggaaaaagatctccgccacctccatctacttcgagagcctgccctacaaggtcagcgcgccaacggctacatcgactacgacaagctcgaggagaaggcaatggacttccgccccaagctcatcatctgcggaggcagcgcctaccccagggattgggactacgccaggctcagggccgtcgccgacaaggtcggggccatgctcctctgcgacatggcgcacatcagcggactggtcgccgcgcaggaagctgcaaatccttttgagttctgtgatgtggttaccactacaacacacaagtctctccggggaccgagggctggtatgatcttctacaggaaaggccctaagcctgcgaagaagggccagcctgagggtgctgtgtatgactatgaggacaagatcaactttgcggtgttcccatcgctccagggcggtccgcacaaccaccagattgctgcccttgcagttgccctgaagcaaactttgactcctggattcaaggcctacgcaaagcaggtcaaggccaacgctgttgccgttggaaaatatctcatgagcaagggttacaagatggtgaccgatggaactgacaaccatcttgttctatgggatctccgccctcttggcttgactggaaacaaggtcgaaaagatgtgtgacctttgcagcattacattgaacaagaatgctgtcttcggtgacagcagtgcattgtccccgggtggtgtccgcattggtgctcccgcgatgacttccaggggtctggtcgagaaggacttcgagcagatcgccgagttcctccaccaggctgtgaccatctgcctgaacatccagaaggagcacggcaagctgctcaaggacttctccaagggcctggtgaacaacaaggacatcgagaacctcaaggttgaggtcgagaagtttgccctctccttcgacatgcctgggttctcgctcgagagcatgaagtacaaggagtaggatgatgatacatatgtcgtggttgtctccgctaatcgtccatacgccatgcgcttctaagccttcttggccgccgcgcaatgccacagtgctgtgcttctatgagatttgtctgctcgccctggagccctggatagttctgtaaacgcgtcccacctttatgctctgtttgccgtccacattccatcatatttctttctaggaattgttcgcctgggatcatggaatgtcgagtatttgccaataatcttccatattatttttgtgtatgctctgcatatgggaaaaatatagtg

SEQ ID NO: 154 - protein, 517 aa, Triticum aestivum
  misc_feature (163)..(467): Each xaa can be any naturally occurring amino acid
MDSVASWGLTPLADADPDVFDLIEREKRRQRSGIELIASENFTSFAVIEALGSALTNKYSEGMPGARYYGGNDVIDEIENLCRDRALAAFRLDAASWGVNVQPYSGSPANFAAYTALLNPHDRIMGLDLPSGGHLTHGYYTAGGKKISATSIYFESLPYKVSXANGYIDYDKLEEKAMDFRPKLIICGGSAYPRDWDYARLRAVADKVGAMLLCDMAHISGLVAAQEAANPFEFCDVVTTTTHKSLRGPRAGMIFYRKGPKPAKKGQPEGAVYDYEDKINFAVFPSLQGGPHNHQIAALAVALKQTLTPGFKAYAKQVKANAVAVGKYLMSKGYKMVTDGTDNHLVLWDLRPLGLTGNKVEKMCDLCSITLNKNAVFGDSSALSPGGVRIGAPAMTSRGLVEKDFEQIAEFLHQAVTICLNIQKEHGKLLKDFSKGLVNNKDIENLKVEVEKFALSFDMPGFSLESXEVQGEDDDTYVVVVSANRPYAMRFKPSWPPRNATVLCFYEICLLALEPWI

SEQ ID NO: 155 - protein, 293 aa, Oryza sativa
  misc_feature (29)..(293): Each Xaa can be any naturally occurring amino acid
HALCVNVHAARSTEAEAEAGQEVEEEEEXEASSCSSSSSSLHPAKRQATAERGADLEARRGAVRAWGNQALAEADPDVHALMELERDRQVRGIELIASENFVCRAVLEALGSHLTNKYSEGHPGARYYGGNQHIDGIERLCHERALAAFGLDPACWGVNVQPYSCTSANLAVYTGLLLPKDRIMGLEPPSGGHVSHGYYTPSGKKVSGASIFFESLSYKVNPQTGYIDYDKLEERAMDFHPKILICGGSSYPREWDFARMRLIADKCGAVLMCXXAHXXGLVAAXXCRXXFXX

SEQ ID NO: 156 - protein, 382 aa, Artificial Sequence
  Consensus amino acid sequence
MDPVSSWGNTPLVDPEIHDLIEKEKRRQCRGIELIASENFTSFAVIEALGSALTNKYSEGMPGNRYYGGNEYIDIENLCRALAFLDPKWGVNVQPYSGSPANFAAYTALLPHDRIMGLDLPSGGHLTHGYYTSGGKKISATSIYFESLPYKVNTTGYIDYDKLEEKALDFRPKLIICGGSAYPRDWDYARFRAIADKCGALLLCDMAHISGLVAAQEAANPFEYCDVVTTTTHKSLRGPRAGMIFYRKGPKPKKGQPEAVYDFEDKINFAVFALQGGPHNHQIGALAVALKQATPGFKAYAQVKANAALGKGNRGLEKLCDITLNKAVFGDLPGGVRIGPAMTSRGVEDFEIGEFLAIIQKGKLKKGLKILKVEFSFMPGFL

SEQ ID NO: 157 - protein, 8 aa, Artificial Sequence
  Conserved motif for the isolated SHSRP homolog
  MISC_FEATURE (1)..(1): Xaa is Leu or Met
XTNKYSEG

SEQ ID NO: 158 - protein, 10 aa, Artificial Sequence
  Conserved motif for the isolated SHSRP homolog
  MISC_FEATURE (5)..(5): Xaa is Gly or Ala
  MISC_FEATURE (7)..(7): Xaa is Asp or Glu
  MISC_FEATURE (8)..(8): Xaa is Thr, Pro or Leu
DRIMXLXXPS

SEQ ID NO: 159 - DNA, 20 bp, Artificial Sequence
  AtSHMT4 forward primer
atggaaccagtctcttcatg

SEQ ID NO: 160 - DNA, 20 bp, Artificial Sequence
  AtSHMT4 reverse primer
ctaatccttgtacttcatct

SEQ ID NO: 161 - DNA, 20 bp, Artificial Sequence
  NOS terminator forward primer
tccccgatcgttcaaacatt

SEQ ID NO: 162 - DNA, 25 bp, Artificial Sequence
  NOS terminator reverse primer
ccatctcataaataacgtcatgcat

We claim:

1. A method of increasing root growth in a plant, the method comprising the steps of:
   a) designing an expression vector comprising a promoter operatively linked to a polynucleotide encoding a polypeptide comprising SEQ ID NO:2;
   b) transforming cells of the plant with the vector of step a);
   c) regenerating transformed plants from the transformed cells of step b);
   d) determining root growth of the regenerated transformed plants of step c); and
   e) selecting transgenic plants:
      i) which demonstrate increased root growth as compared to a non-transgenic control plant of the same species; and
      ii) which comprise the polynucleotide.

2. The method of claim 1, wherein the polynucleotide comprises SEQ ID NO:1.

3. The method of claim 1, wherein the plant species is a dicot.

4. The method of claim 1, wherein the plant species is a monocot.

5. The method of claim 1, wherein the plant species is selected from the group consisting of maize, wheat, rye, oat, triticale, rice, barley, sorghum, millet, sugarcane, soybean, peanut, cotton, rapeseed, canola, manihot, pepper, sunflower, tagetes, potato, tobacco, eggplant, tomato, Vicia species, pea, alfalfa, coffee, cacao, tea, Salix species, oil palm, coconut, canarygrass, bromegrass, wildrye grass, bluegrass, orchardgrass, alfalfa, sainfoin, birdsfoot trefoil, alsike clover, red clover, and sweet clover.

6. The method of claim 5, wherein the plant species is maize.

7. The method of claim 5, wherein the plant species is wheat.

8. The method of claim 5, wherein the plant species is rice.

9. The method of claim 5, wherein the plant species is sugarcane.

10. The method of claim 5, wherein the plant species is soybean.

11. The method of claim 6, wherein the plant species is cotton.

12. The method of claim 7, wherein the plant species is rapeseed or canola.

* * * * *